United States Patent 7,745,391 (HUMAN THROMBOSPONDIN POLYPEPTIDE) - sequence listing, part 137

SEQ ID NO: 367542 - DNA, 11338 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatggtgagcaggagggttaatttgcggggtgggctggcctgggttgagggacctcgtggagtaactgccatcatggcaggagccctggctgcccctcagtcctgccccaatccctcagccctccctctccagaagcccccagacctctgggcctccaccctgg

SEQ ID NO: 367543 - DNA, 10460 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccggggagggagtggatgtcgtagagggagagatgtcgtagagggatagtatgt

SEQ ID NO: 367544 - DNA, 10857 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtct

SEQ ID NO: 367545 - DNA, 5224 bp, Homo sapiens
  misc_feature (1383)..(1383): n is a, c, g, or t
  misc_feature (1392)..(1392): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtgggccccagccaagcaccagggtcagccgtgactcagacatgagttcacctctgcgccgtctctcagcaggcaggcacctgccacctgcatggccatatcgtggttaggcacgtggcttttgcagtcccatagacattggtctgaaccccagctctgccgcttgccagccagacaccatttgataaacctcaacttcatggtggctgaggggattggagatcgtgcctggcacataataagtgctcagctgttcatgacttttagctttcatgcagttattctacaaacagatctgggagaggccgggaaatataaagacaagtgagacacagtttcagtgtcattcacgtgcccgctccgacttcactcatccacactgctggctctgtgcttgtgttggacacagtaattctcatgataggtcatgtgtgttgagctctcactatgtgctaggcagcatcctttacaaatcacaaatcacaactgtgtgagacaggtcctgctactgccccatttcataaataaggcaagaggggcttggtaacttacccaaagccccgcagctgggaggtgggaatgccgggatccaaacccaggtcagaggctgcccttcaaatgctctgccaaaggccagagcccacacctgtaattccagcactttggaaggctgaggcgggaggaccacttgagctcaggagtttgagaccagcctgggcaatgtgacgaaaccccgtctctacaaaaagtacaaaaaattagctgggcgtgttggtgcatgcctgtagtcccagctatttagggaggctgaggtgggaggatcgctggtacccaggatggggaggttgcagtgagccataattgcaccattgcactccagcctgggtgacagagtaagaccctgtctcaaaaaaaaaaaa

SEQ ID NO: 367546 - DNA, 2638 bp, Homo sapiens
  misc_feature (1383)..(1383): n is a, c, g, or t
  misc_feature (1392)..(1392): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatagcattcaacgcctccgagcctatcaacgccctcgggcattcaaagcctccgg

SEQ ID NO: 367547 - DNA, 1005 bp, Homo sapiens
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacaggtgagcctatcctggtgtctgggatcgcctcctccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccgttagacccgagttctgctccttccttctagacctctgcacattgacaataggtaatcaggcctttatttatcctgtacttccaagtccaaaacacattagtacttaataataatgagcaactgtttactgagcactgactgcctttatttccagcc

SEQ ID NO: 367548 - DNA, 348 bp, Homo sapiens
ggcgtgagccaccacgcccagcccaattgcaaagcattctatcagttgttttcaactccctgatgtcttattattttttctttatagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaagg

SEQ ID NO: 367549 - DNA, 459 bp, Homo sapiens
gacctcaacctcacggcgcacggcatctcccactgccccacctgtcgggaccggccctgccaggtgaccccacaccccacacaccacctggctgccgtggcctccacccctagccatggctggcccctgtggggattatggggggtactgaatgttctcggccttacttctgggggctgctttgcagaatggcggtcagtgccatgactctgagagcagcagctacgtgtgcgtctgcccagctggcttcaccgggagccgctgtgagcactcgcaggccctgcactgccatccaggtacgcaccccgaccgccagtccgtgtcgccccagggcctgcctcttccctttgctgcctccccatatccaccaccatctcaaccactggggcacttccacaccccccactctcacctgagcactctccactcctcccatgtacccatcccccatctctgcta

SEQ ID NO: 367550 - DNA, 396 bp, Homo sapiens
ccttctgagaggcagtggttaaatcctggccttactgcctgctcagtgtcacttggtgtgagatacacttcactttcagggcctcagctgcctcatctgtgaaatggggtagtccaccctcctcagccccttgtgtgagagttgaatgaggctatgcatgtggaactcttagcacagtgccaggcatgcagtggcactgaggacacatgagttcacatgcctgttcttcccctcccctctcccctggtcctgaaggaggatcgggggagaggaaggagccactgcgttcctgactagaaatctgcccccacactcagggctgcccacacttgttttctggacacagacggccaccccacctgtgatgcgtgctccccaggccacagtgggcgtcac

SEQ ID NO: 367551 - DNA, 347 bp, Homo sapiens
cagatctgaagcgtctcagtgtccccaggatgtggcacaggcttggccaagagcaaacgctcaatgttggaaggtgggcctgaggcacagatgggaggtgggcccctggagccgtgggccaaggccagggccctcagtgctagtgcatttgcagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccaggtaagacaccacccctaagaattggcagtgccctgcccactccct

SEQ ID NO: 367552 - DNA, 420 bp, Homo sapiens
atgcattgaccatgcgagctcctgcgaccctgttgtatggccgctagcccgaattgccgcgcgcagctcgaacgtgcctcaggacagcccgtgcacgcctgtattgtgtggagtcgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaaggcaacaagactgaaactccgtctcaa

SEQ ID NO: 367553 - DNA, 14328 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtgttcatctctgttttctaatacgcaccggttgttttttttcg

SEQ ID NO: 367554 - DNA, 11611 bp, Homo sapiens
  misc_feature (43)..(43): n is a, c, g, or t
  misc_feature (2472)..(2474): n is a, c, g, or t
  misc_feature (6302)..(6302): n is a, c, g, or t
  misc_feature (6346)..(6346): n is a, c, g, or t
ccgtgttatgagaagtggagatggcgactcgtagaggctgcgntgtagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367555 - DNA, 10653 bp, Homo sapiens
  misc_feature (1514)..(1516): n is a, c, g, or t
  misc_feature (5344)..(5344): n is a, c, g, or t
  misc_feature (5388)..(5388): n is a, c, g, or t
tatcccgtcacgcccactagggactgcgctgtgcccctgctacggagacctgctgccggcaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367556 - DNA, 8654 bp, Homo sapiens
  misc_feature (3345)..(3345): n is a, c, g, or t
  misc_feature (3389)..(3389): n is a, c, g, or t
tgttcatagctgattctagaggataaactaacggcgagtgcgtcataatggtggagctccgctgctccccggcagaaagaccccactcccaccactcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367557 - DNA, 8450 bp, Homo sapiens
  misc_feature (3141)..(3141): n is a, c, g, or t
  misc_feature (3185)..(3185): n is a, c, g, or t
ctgacctccttataggcgagtcgggtagcaggtggcaggtagtgctccacgtgcatggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367558 - DNA, 9764 bp, Homo sapiens
  misc_feature (625)..(627): n is a, c, g, or t
  misc_feature (4455)..(4455): n is a, c, g, or t
  misc_feature (4499)..(4499): n is a, c, g, or t
cgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagtactcatgccatcggcatccactgcttccgccagaaccacaaatatccgatctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367559 - DNA, 3853 bp, Homo sapiens
  misc_feature (43)..(43): n is a, c, g, or t
  misc_feature (45)..(46): n is a, c, g, or t
aactcacacccatcaaccctcaataagctaggtacgagctggntnnaatcggccgaggccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367560 - DNA, 14153 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcaccccacgcctggcctctgtgtcctagaagggaccctcctgtggtctttgtcttgatttttcttaataaacggtgctatccccgtttattacacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367561 - DNA, 2709 bp, Homo sapiens
cccttattgagtgagggcccccaaagaggacccctgtcatattggagctcctcccagccccgtgtgcaagggcaggggggctcctgtgccactgcagctggtgccaactggtcctgagcctctgggcctggagagtgaggcaggcaagggtcccagaggaaggcagagtagctggaccccacccgagggtccaggatccccactgcctcagctgagctgtggctgctgcaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367562 - DNA, 13683 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367563 - DNA, 13489 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctctgtgtcctagaagggaccctcctgtggtctttgtcttgatttttcttaataaacggtgctatccccgcca

SEQ ID NO: 367564 - DNA, 1260 bp, Homo sapiens
cctaccaccgatggagcccccagatagagctgggtggcctgtttctgcagcccttggcgagttctcactcctaggagagccaacctcggcttgtgggctggtgcccacagctacctgagacgggcatcgcaggagtctctgccacccactcaggattgggaattgtctttagtgccggctgtggagcaaaaggcagctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367565 - DNA, 11062 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtct

SEQ ID NO: 367566 - DNA, 5651 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggtgaaatggaccctctcctacacagcaggcccacagggcagcccactctctgaccccgatgt

SEQ ID NO: 367567 - DNA, 4115 bp, Homo sapiens
  misc_feature (1383)..(1383): n is a, c, g, or t
  misc_feature (1392)..(1392): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggtcagtccgaatccctgtccctgcggggcctgctctgccccgctgcccagaccctgcggggaaatcaggcagcatctggtggaagccgagacctgggcatggggggcagggcatgggggacagggcaggggctgcccggggctg

SEQ ID NO: 367568 - DNA, 2973 bp, Homo sapiens
  misc_feature (1383)..(1383): n is a, c, g, or t
  misc_feature (1392)..(1392): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcagtgagtatggctgccaccatcccctgacacccacctcccaacccaacctgggctgcacaccaggcaccctccctccctgccccagctcatgaaccttggggagccactgttcctctatctgcccggaccacgtatatcccattcccacctgccctgccaacactcgttttgtgtcccagaccaggagattgtgcgctgtgacgagcgtggcagcatggggacctccggggaggcctgccgctgtaaggcaacaagactgaaactccgtctcaa

SEQ ID NO: 367569 - DNA, 257 bp, Homo sapiens
gctgggggtccagccctcctctctcacttttcaataagtcctcctggctagggatggtggaatgtggcccagccctgcagccctcagctcccggctcccaggtggaacagccactgatcacatcttcctttccagcacagacccccccacccccgccggccgctgtggcggtcgcagtgacaccaggtgagagtgtaagccaggccgaggcccagccaggttcctagagaagttaaggttggagaggaggccgggtg

SEQ ID NO: 367570 - DNA, 388 bp, Homo sapiens
gagctattgcggcttcggttccagaccaccacaatgaagcaaattccacatgaaagcaagtgacacacactttttggttttccaatgcatataaaagttacgtttgggctgggtgtggtagctcacacctataagcctacccctttgggaggctgaggcaggaggattgcttgagcccaggagtttgagatcagcctgggcatcatgccaagacctcatctttacaaaaaataaaataactagccaggtatggtggtagcatgtctgtggtcccagctacccgaggctgaggtgggaggattgcttgggcccaggaggtcaaggctgcagtgagccatgttcacatcactgtactccaacctgggcaaaggagcaagaccctgtctca

SEQ ID NO: 367571 - DNA, 704 bp, Homo sapiens
cacgctcccctcgactgcgctccagcctggggcgcgcccggccgccgccgccttcgctgccgccacgggcccgtcttcttcctccttcggctcccaggatgaagaaactgagtctcagagaggtgaagtgacttgcccaagatcacagcaattatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgcccttccgagtacatccttctgcttcccccattgcagccttcttagaaatgcagcagcagtctcacccatcaggagcaaaagaaaatcaaagaccaaaaggagaaagcctcagagcttttgcgactgtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaa

SEQ ID NO: 367572 - DNA, 455 bp, Homo sapiens
ctgactcccggaccttactaaaggcgttactaaacggctgtatagtctaagtctttaagatggctccaccaaccatccctacttaactgagagatgacattctctgagggagtggagtattcagttttctttgttgacttagtcaccctgagtagcagcattaatgtcattttgtttttcttatcattttgtaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgaggtgaggaggtagaaagggtacctctgggccacagggggaaggaagaaagaagggaagccttcagttagggttatgatgataaaagatcaaattacagcgtttttaaaa

SEQ ID NO: 367573 - DNA, 1069 bp, Homo sapiens
aaagagggggagagagggccaatttgggcacctgtttgtaagtgcaggtgactaaagcgccatcagaaggtagaaactggtggaaaatggttttagaaggatggtcaggagaacacatcatgctcaattgctcagtcaggtgcttcaatgtcatacaactgagataaaatctagagaaaggatcaggcacagaaacatattccctctctctccttgggcctggcctgttcctttgatattagtgtagacacctaaaggactgagccagttgctattcttgggcactttccttctcaaaatagccaaatctagcccttcatgcctggcgtgtaatcattttatttaatgagtctctggattgatgagacatttgatttataaagtcagctcaattattaagaagctcgattaacttatgaattatccaggtctttgatttttctttctactccaattcttctacttttgcatattatgtagcaaatctctggttctagtggagggattgatcagaaccactaaattattatcatcaccattatcatgtgtggatttcaagcatctgggctctttcttctccatttccaaagataataacagcagtctggtgaaggagctctcaaaccaaaacctgaactagaaacattctcataattatcctgattatccaatccatagacccagatcaatggactgtccaaatgaggggagctttccgaatatgatttctatgtcttttcctattctagtctcccaccaacttttccatccttgagatataaccttcctgttttacatttcagggagtttcttgtatttgcaaaatgtgaattacgaaatgtctcttgacccctttgcattttaattagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggtcagtgtgaatctgtcaatattgacacaaagtctcgctctatcgcttag

SEQ ID NO: 367574 - DNA, 724 bp, Homo sapiens
gtttggggtagtcagcactaatattttgctgcatggctttttaagcccttcggtttatgtttcagtggtccttgtaataaactgtcactaatgcagtagggtgtaatcagctttgctaagctctgcacagtaaaattgttctttcttagttaatattccagtgttctaatgttttgagcagaaggcatccttactttgtattcccatagttcttcagtgatgcacgagagctggagtcattcttgaggaacctccaagattccattaaacgaaaatattcctgtgaccacaacaccagcttatcccgccttgaagacctgctccaggactccatggtgggtgttgcctcagtggggatgattacttctgagaaagagagtaaaccatatcagctgctgctgtttatatccttgaaagctccagggcaatgggccattgttgtaataaagtttggcttacattcaaatagagtttaatcgatgttgttctgtctctttcctttttttccttttcttttcttaaataagttgctaataagatttctttgggtatgttattgaagtaaaggcctagtcttctcctctgagccactttgagctcattgtactttctttgcatttttcttattttaatgtaatagttggagccaaggatgaggtgttgagcatgaagaaaaggttgaaggggattagttgatatcaaattcttttttactctcttatgc

SEQ ID NO: 367575 - DNA, 577 bp, Homo sapiens
tcgactctgctaagatcatgttgtcaacacttctttatggaaagaatgatctctttgaggataatgcattgcaaaatgaaaaatctctcatgttcatgtttatggacaacctccttttttggcttcactaaatatttgcttagaaaacaaaatcaaatttctttgcattgatttaagcctaaacctgaagcaaattgtagttagggactatatacaggactatatgtcatcctagccattccatctttataccattagaggacttagaagcactaaagtcgaaggctctgccattcctattttcttgtgttaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaaggtaatagactgctatgacgcttgatattt

SEQ ID NO: 367576 - DNA, 4161 bp, Homo sapiens
  misc_feature (378)..(378): n is a, c, g, or t
  misc_feature (1076)..(1076): n is a, c, g, or t
  misc_feature (1849)..(1849): n is a, c, g, or t
  misc_feature (2024)..(2024): n is a, c, g, or t
  misc_feature (2222)..(2222): n is a, c, g, or t
ttccagacatgtccttccaacccagagttcccctcctttttcagctacgcttcttgttccctgtctcatctccttttttcccatcactccccaagtccctgtggtctggctgacactgttctggtcacattctactggctaaatccaacagagttttttcagtctttattttgtttgacatgtaacctagctggctcttcatcccttcccaaaacttcccttttgacttctgtgtcctttaatctttgtgttttcctctgatctctctgaccgttcctttttagcctttttagctggttcctcttccctgcctattcatcagtgttgttccctgacgtctcattcttgatgctctcctcactctgctaagatttatcnggtctaacagctttagctattacctataaagcttctgcatctttttcatcttcagcactatcatctcctaaagtccagacatacagtaaactagaagcagttctaaaatttccactttatctttgcccccttgcctgacgtcatttgtccattctagatctgccccccctttcctcattcagaggcctgtgatgtctggagttcctccttttcctcacatctagtcactcaccagggcttgtcagtcccactttcaaaatacctcttggttccatctttccggccctggctctggccctcaccatgttttgcctcagttgctgcaatggtttcttaacctgtcttctcactgctagccactccccatcccacacttacccccacccccacatcactccatgttttacactgaagccagagtgatagctgtaaagcatgggtctgatcatgtctcttacctggatcgaaatccttcagctgccccctgttgctctcagaataaatggccaacccttagcctgacacagaagcctttcgtgatctgtctcctgcctgcctctccaaccctgcctcttgccattcctctgattgcatcctctgcccagccagtgagtggaggggtcctggtcacagcactgtcaggcatccctgtctctgtttgggttgcaccctcttccaggactgccttcccaccattngttgactgtttcttcattgctcagtgtgtcagtccgtttgcattgctataaaggaattcctgagactgggtaatttataaagaaaataggtttattttggcttacggttctgcaggctgtacgggaagcatggtgccaatatctgcttctggtgagggcttcaggaagcttagaatcatggtggaaggcaaaggggagccagcgtgttacatggcaagagagggagagagagaaagaggaggagatagcaggctccttttaaacagccagttctcatgtgaactaacagcaagaactcactcattaccatggggagggcaccaaggccattcatgaggaatttgcccccataactcaatcacatcccgttagaccccacctccagcattggaaatcacatttcaacatgagatttggaggggacaaatatccaaactacatccctcagtaactcaactcaggcaccagcctccacacagcctttcctgccaccacaggccgtaaagtacccatcctagctcttcctttgcccccataagagtaaaaatacaatatttaactctttttcctattttttgtgtttaacagacatttatggaggagatgactcgcaaacagcctgacgtggaccgggtcaccaagacatacaaaaggaaaaacatagagcctactcacgcgcctttcatagagaaatcccgcagcggaggcagtatgtttccagccccctgtgttaggatgcttcattcctgctaattgaggatgagcactttccnaatgcctatcaaaaaaaattatattccattttcaaaaaccgtgttggttttgaaccaaaatctctcatttttgaaactcacttttcttacattgacagacagtagctgtactccatattctttggtatgattggtatgaaattacgaggtggttaagcttattttttaacagtgncctttccattgttttggttatcagccctagctgtttacatttggcttgtactaatttaatcaacacaacagcttctacagaatatgttgcttttttagttgagttaacgtgtcatcagctcactaaggtaggacagaattgcttggagatatgtaggcagcaggtaagtatgtgctgggaggatcagtacttttgganttagtacacctccgtatctaaatattgccaagtcccgtatttcttttctcagttattgactggatattattataaagatcttctaggtttatacatacagctatttctctttgtatactaaccagctgttctaatcttgtgattatttttccttttagggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccgggtaaggaagagaaaaagcagtcctttgttgtggtggtttctcatatgtggctgatcccaccttttcctcctgatgcttagaggcccagagcccatcggacttgagatgtggtcactctctgacctcatctctatagatgccaagtgtcaggtaccctgttacatctgaaaactagtcccatatctacctagatagtagtagtttgtatttaagttttaagataggagatatttcagagctgtcacttcacatctgacaaagttcctagggggatgaaggtacctttggaaacaattatatctattgactgaccacttgcccacaaagagatggtcattgtgagcctgagtggctcccaggctagagaggcctggggaaactgtgttgaagccccaacagacactgtgcctgctctgagctgggctacaaatggggcccaggagcactgaggagacatcaggctcagtggtcttccctggaaagccatgctaggtgtggccataactgacagtgaactatacttgtgttttagcttcttttgggaccagggtcagggacatagaaggatctgaaacaggtctcctaaaatatatcaacagctcgtcaagattctctaaagtcctaagaaaaatctatgattggcaaagaggatttagattgcactaagaaacacaggaaggtccatgtttcattagtatatccaaaatgtcctcaaagtacaccaaatctaccccatgctgcagtctcctgaggagtgctgggtgaatctgctttgaatataacctagggcatttagttaataaagctccatataatcttatgcctgcttgttggattttgttttcttgttttttgtttttaattatctatgagagaaatgaattaacaagaacaacatagcatggagagttagttcatagtttataaaaccacatccctggccgggcgtggtggctcacacctgtaattccagaattttggaaggtagagaggcgagcgagcggatcacttgaggtcaggaattcgagaccaacctggccaacatggtgaaacaccctctctactaataacacaaaaattagctgggcttggtagcgcatgcctgtaatcccaactactagggaggctgaggcaggagaattgcttgaacgccggggtcggaggttgcagtgagccatgatcgcgccactgcactccagcctgggcaacagagcgagactctca

SEQ ID NO: 367577 - DNA, 438 bp, Homo sapiens
ggtttggtaccaataattggtaaagctgatgtaattctaagtttttctcatccagcgcataggaaagcttgcctataggtatctgatttaattattttgaatagtcaatgggctaaccaaggagaagatgaggggatcaaatatctgatgtttaaattaaactagtattcatctctttactttaaatttggtctcttaaaggtctcgcattttgtttcatttgtagtgccacagtttcaggattaatgggtattctttcctttcagggctttaaatgaagaaattgttaatagaaagaagaatgtagatcaagctattaaaaatggtcaggctcttctaaaacaaaccacaggtactttggaaaagtgtgtcctcttaggcacccctatgggtctcaaagacaattatgtacccaaggaaaggagttccctgccttag

SEQ ID NO: 367578 - DNA, 438 bp, Homo sapiens
tgtgtaaactcatgtgtgatgtgtagatggtggcgtttcatgtgccttgctggacttttacagacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggtaaagtcaaggacttaaatttttttggtaaaatc

SEQ ID NO: 367579 - DNA, 18417 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagcttaatag

SEQ ID NO: 367580 - DNA, 18112 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatga

SEQ ID NO: 367581 - DNA, 15239 bp, Homo sapiens
  misc_feature (71)..(71): n is a, c, g, or t
  misc_feature (99)..(99): n is a, c, g, or t
  misc_feature (102)..(102): n is a, c, g, or t
  misc_feature (130)..(130): n is a, c, g, or t
  misc_feature (2198)..(2198): n is a, c, g, or t
ggggggggggggatgggagaaggaagaggggggggggaaagggagggagaggaaggggggggggggggggntttaaaagggggagggggggtaaagaanaanaaaggggggggggggggggggggggggnaaaccaagcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgnctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgcagctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367582 - DNA, 6533 bp, Homo sapiens
  misc_feature (29)..(29): n is a, c, g, or t
cgttatagaggatcccggatacccatttnttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367583 - DNA, 18300 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367584 - DNA, 18339 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367585 - DNA, 18411 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367586 - DNA, 19218 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcaggtaagtacctgccccgtgacctacaagccaggctgagaatttggaaacaacagcctatgtggaatgtttcactgctcccaaggagcgggtaatgagagtggcacttagtgtgatgcccagaaagacagacctgcagatgctcaagtgacctttactttttctgtcattacagctagctttaagctttccttctgagatgagatgcttccacagccaaagctgggccatgcgttctcatcagaaatgatcacatttgagagaatgtaaaaggaaatgtgggtcttcctcagacaccagtccagtgttgggatgagcagcttgctagtaatttttccaacacgtcatacttactatggctgctgttgaaccaagaaaggcaggggaagatcacatctgttctcctgctactgttcctcatgggaacctaggaatcttccttcatttcctggctggctgcttcccctcattttgcctctatccatcctgcccatggattagcccggctggcaggctcacccacctgtgctgaggtggttgagcaaccttgcttgcctccactttggggccatggaaggtgacagtgctgctgatagagtggctttctaatccccaggaggcagcttctcaagtagaatcacaaagccagaaaaggcttcagcaacttctgtatggatgaggaaactggggtgcagaaaggctgtgagatttgcttaagatcacacaggatcagaaccctagcttctgctcacttgttcttccaccccatgccatctctattaagtctgctgttttattcttgaattccagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367587 - DNA, 3425 bp, Homo sapiens
ttagaggatcccaccctactgtgcttctgggggaccttgacctcgtcactgagctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367588 - DNA, 1970 bp, Homo sapiens
ctctacaggatctgatcgtaatatgtaaccaggtgcagcagagtggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367589 - DNA, 17535 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttcacgacctcccctcccttgtttcagaggatgaggagatatacaataaaaatattcatcctc

SEQ ID NO: 367590 - DNA, 17340 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagggtatgtactgatctccattatgcccttcttccccaatcccaccctcacagatgttcattgttcacggtagcctctgaaagactccagtgaggagaagaaataaaaatgaaaacatgttttctattttagaaataaaacgtgaaaacacacagatcaagactgccctgttcctagcagtacacagatatatggcctttaagatgactccaaaggacatttattaaaatatgcactcagcctggttatgtcagaaatgtttatttcctcatgttctcagtttaagtttgagcccatccagtgttactacttttgaaaatccaggctggacacagtggctcatgcctgtaatcccagcctttgggaagctgtggtgggaggatcccttgagaccagaagttgaagaccagcgtgggcaacatagcaagaccatctctacaaatttctaaatttatcatctctaatttttaaatttagcctagcatggtggtgagcacctatagtcccagctactcaggaagctgaggcaagaggattgcttgagcccaggaatacaaggctgcagtaagctatgaactgcaccactgcactccagcctgggcaacagagtgagactctgtctctaaaaaataaaaatt

SEQ ID NO: 367591 - DNA, 16725 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggtaagggaaataattatattttgagtacacttctggctgtaggtttgtaatatcctgaatttggttgggttcagtgatcatattagcctttgacttgtctgttgggagataattatttggagttctatttatgtgtaacgggcccacgactgctcgcgaacacgagatggtgatagcgcctaagtcatagtgttagagatttggattagtagggctattttactgctatgggcatgaaagcgctggatactgaatcatgtcgtagtgctttccatccccaaacagctacatatttgataaactaatcacattctagtctctaatacacctgatttctctttgcagtttagagtgcagatagctgcctctcacatgacactcatggagtgtcccccttcaggaagggatgaaggagctggacatgaa

SEQ ID NO: 367592 - DNA, 16360 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaatgacaatgtggctcatgtgcaagatgtgcaaaacaggtttcagtgtgtgagcag

SEQ ID NO: 367593 - DNA, 1535 bp, Homo sapiens
gcgcctcggtaatattttttaaatatatcctacccaattttttcccagaacattatacccttgtgtgaccccaataaacccttgaaatgtgtatatatcccctaaggccgttataaaatttctccttaggaggatattttttcccacttatgttccccccccccccacatagtagggttcttctttttccacaaatgtcccccgtatcgcccgttttttcgtccctccccggctttgttttacgatcgcgccgccgcggcgcctgctttttttattacgggcctctctcctcttgggggcccctctctttgcagcaaaaaaggggggcaatggggccccccgggggaatttttgccgccccccccctctttttttttttttttttttttttttttttttttttttttttttggacccggaagtagaatttattggtgagtattaagaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367594 - DNA, 15828 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggtaggggtgaggtctgggctacattggagtgcagtgggtcttctgtatatgactgcctagggtcttctacatatgactgcctctgcccttctttctaggggagaaagagagcctgacagttgctttgtgtgtttaaacaaactgttgctgagattctgcattagtcacaacgaatttaccaaaattggtttgattcagatttggcaatgtgtaaacttcacttcaaggttgcgcctcttcctgtttgtttctctcagttgagtcacaaaatggatctaaattccaacggaaacccataagatagccatttccactgactcctaaaatggaaatgagtgattttttttttaaaccacttctgaacctaacaatcctaacaccaggcacgccaatatttaacataatctctatctgtcatgttgaattatgtaatatcctcctgtttcagcacaagcatttaactttaccttgaaattacaacagattcttattatgtgcacagcagatgtttttatttcccataattctggaaacgttagtataatggttaccattttacagatgaagaaactgggccttaagcaacttttcaaaattatgtatctcctaaatgcctgagctagcatttacagccacattttctggttgtttttttctttcttttttctttttttccccttgagattgggtctcgccatgttgcccagactggtcttgaactcctgggctcaagcagtcctctcatctcggcttcccaaaatgctgggattacaggcatgagccactgcg

SEQ ID NO: 367595 - DNA, 14465 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaaggtacagtgtatgatccccatgtttgagtaatttgctgagtgattgcatgtataataattgccatcttatttatatgaagattttttgaagaccagggtattgtaacagaagttgcagaactgattccatctgtgttgagttgcattgatggtataagtttctgttgttatttgcttttataactaagggttcttcacattccacacacctaagagccacagtccagatcctgagtctgc

SEQ ID NO: 367596 - DNA, 551 bp, Homo sapiens
  misc_feature (7)..(7): n is a, c, g, or t
  misc_feature (9)..(10): n is a, c, g, or t
ccatgtngnngacgtggtcgcagtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367597 - DNA, 13223 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaatgaagctctaccaatgaactgtttagaaacaagacacacttttgtattaaaattgcttgcagtaacaaa

SEQ ID NO: 367598 - DNA, 12170 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 367599 - DNA, 3744 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggtgggtgttgcctcagtggggatgattacttctgagaaagagagtaaaccatatcagctgctgctgtttatatccttgaaagctccagggcaatgggccattgttgtaataaagtttggcttacattcaaatagagtttaatcgatgttgttctgtctctttcctttttttccttttcttttcttaaataagttgctaataagatttctttgggtatgttattgaagtaaaggcctagtcttctcctctgagccactttgagctcattgtactttctttgcatttttcttattttaatgtaatagttggagccaaggatgaggtgttgagcatgaagaaaaggttgaaggggattagttgatatcaaattcttttttactctcttatgc

SEQ ID NO: 367600 - DNA, 369 bp, Homo sapiens
aattaagcaacagattttaaaaaaaagaacaaaggaaagagtcattgggttaaagacctaagtagtgtcataactctctgtaattacatgtccataggagaatgtattgaaatacaaaaccacatgttttcttgatgcttcacgtgcaaatgcttgttctttctttttattcctggtcgtctttcattaagtcataaatgccccaagaataaccagtctctgcgtggtatagagagtctaatagcctttgtattaaatcttctttggcttgtaattatctagatgtttcagaaagaacaagtggatcctcttcagatgaaattgcagcaggtgaatggacttggccagggattaattcagagtgcagga

SEQ ID NO: 367601 - DNA, 132 bp, Homo sapiens
ttttctttctggaaacataggagtttcagaagactcttggtggcaagcagcctgtgtatgataccacaattagaactggcagagcactgaaagaaaagactttgcttcccgaagatactcagaaacttgaca

SEQ ID NO: 367602 - DNA, 341 bp, Homo sapiens
agagtaagattgaagacctctttccccagaaatgtccaaacaagggcaatatattcctgagtttggtacgcttcaatgttatatgcggttgttcagccaaacctgctatggaaaagattatgagaaagaaaggccatgttaggtaactgatgtctggagtcacagaatgaactactcttagctcaagttgactttataaaacttagtctggcaagtaacaaaactgcttcattgacagagagaaagatgcatcatcttgccaggaacagttggatgaattccggaagctggtcaggaccttccagaaatggttgaaagaaactgaagggagtattccacct

SEQ ID NO: 367603 - DNA, 316 bp, Homo sapiens
gtcggggagcctgtctccctgtcccccaggggacaccttgccctggaacctgccactgcatgagcagaaaaagcggaaaagccaggattcggtgctggaccctgcagagcgtgctgtggtcagagtcgctggtaagagaggtcccccagcaggctggacgctgtgggtgtgagggaggaatgggccagggcacagcagctgtgtggggagccgaggggtcctcaccagggcctctgacaaagcagccatcatctgatttgttattattattcttggaaagacgttgaaataacattaacgaaaaactcaaaagagg

SEQ ID NO: 367604 - DNA, 650 bp, Homo sapiens
atctgagcttctggttttagaaattgtatcataattctattttgtaccccagtgtttggcatggtgccagtcatatagtaaatgttcaatagatatttgataaatgaataaataaatcagaaggatggtctcttaatgcttttcaaaacactagggagtatatacagaacagatgtccctacttatgaggaaaaagccccagatactacatttggccattttcttctttaaacagagtctactagatgactgggcaagtaagggaactctggtggaagaaatcaattgcaaaggtacttctttagaaaatctcatcatggaaatcacagcacctgattcccaaggcaagacaggtgagtacaggctcttcaaaatatagtgaataaaaattgctctttgcttttggcctttggagatgcctccttatataattaaagtgaaaatcaaggttggatatgaaaacaaagggcatgcccaaagcagtcttcccctgcaacctgacctgtcaccccttttgctatataacattgctccattttgcaaaattccttcccatgatggaaaaagtaaatgaactagttgtcccacttagaactatcaaatgaacactgaataattaaaatgagattttcatcttgagaatttccctt

SEQ ID NO: 367605 - DNA, 290 bp, Homo sapiens
tggtttatgcactgttttgtatatatgttacttcagtaaaatggaggaaaagaggaagtgttacatttttattctgttgcaatttcttctggctttttctttctagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatg

SEQ ID NO: 367606 - DNA, 18280 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367607 - DNA, 18489 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgatttccaccttgccaaaggtggcactcaggattctcccagtggatcttttggctttcacccttggtcctctcacagtcggctgcagccagaaagatcctgttacctgtaatccacgtattgtcccttactcttttttgctagaatctccgtggttcccgggactgagctgtcctctcctattcttccatccat

SEQ ID NO: 367608 - DNA, 17826 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaataaccgtataactcttggtgttaccaggacccaaaccctttgcaagggattaggctgttggtgaactttggttctt

SEQ ID NO: 367609 - DNA, 7960 bp, Homo sapiens
gcggtgaggtacagctggcatctcacggagagtgcccaggaacgctgctgaacatcctgcagtgcacaggagagtcctccacaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367610 - DNA, 18393 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367611 - DNA, 18988 bp, Homo sapiens
  misc_feature (995)..(995): n is a, c, g, or t
  misc_feature (1066)..(1066): n is a, c, g, or t
  misc_feature (1076)..(1076): n is a, c, g, or t
  misc_feature (15881)..(15881): n is a, c, g, or t
  misc_feature (16056)..(16056): n is a, c, g, or t
  misc_feature (16254)..(16254): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcagtatgtttccagccccctgtgttaggatgcttcattcctgctaattgaggatgagcactttccnaatgcctatcaaaaaaaattatattccattttcaaaaaccgtgttggttttgaaccaaaatctctcatttttgaaactcacttttcttacattgacagacagtagctgtactccatattctttggtatgattggtatgaaattacgaggtggttaagcttattttttaacagtgncctttccattgttttggttatcagccctagctgtttacatttggcttgtactaatttaatcaacacaacagcttctacagaatatgttgcttttttagttgagttaacgtgtcatcagctcactaaggtaggacagaattgcttggagatatgtaggcagcaggtaagtatgtgctgggaggatcagtacttttgganttagtacacctccgtatctaaatattgccaagtcccgtatttcttttctcagttattgactggatattattataaagatcttctaggtttatacatacagctatttctctttgtatactaaccagctgttctaatcttgtgattatttttccttttagggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367612 - DNA, 18369 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagttcaccatcctgggagtaaaataaagcgctctgattccagctcttcgatttccagtcagtctcccatagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367613 - DNA, 17920 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagcttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367614 - DNA, 17576 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaaaagtcgacgcggccgcgaatttagtagtagtaggcggccgctctagaggatc

SEQ ID NO: 367615 - DNA, 17487 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgagacgccctcaccgctaaaacttcaaagaaaaagtactcataaaaaaagtcttaccccccatg

SEQ ID NO: 367616 - DNA, 17598 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccgggtaaggaagagaaaaagcagtcctttgttgtggtggtttctcatatgtggctgatcccaccttttcctcctgatgcttagaggcccagagcccatcggacttgagatgtggtcactctctgacctcatctctatagatgccaagtgtcaggtaccctgttacatctgaaaactagtcccatatctacctagatagtagtagtttgtatttaagttttaagataggagatatttcagagctgtcacttcacatctgacaaagttcctagggggatgaaggtacctttggaaacaattatatctattgactgaccacttgcccacaaagagatggtcattgtgagcctgagtggctcccaggctagagaggcctggggaaactgtgttgaagccccaacagacactgtgcctgctctgagctgggctacaaatggggcccaggagcactgaggagacatcaggctcagtggtcttccctggaaagccatgctaggtgtggccataactgacagtgaactatacttgtgttttagcttcttttgggaccagggtcagggacatagaaggatctgaaacaggtctcctaaaatatatcaacagctcgtcaagattctctaaagtcctaagaaaaatctatgattggcaaagaggatttagattgcactaagaaacacaggaaggtccatgtttcattagtatatccaaaatgtcctcaaagtacaccaaatctaccccatgctgcagtctcctgaggagtgctgggtgaatctgctttgaatataacctagggcatttagttaataaagctccatataatcttatgcctgcttgttggattttgttttcttgttttttgtttttaattatctatgagagaaatgaattaacaagaacaacatagcatggagagttagttcatagtttataaaaccacatccctggccgggcgtggtggctcacacctgtaattccagaattttggaaggtagagaggcgagcgagcggatcacttgaggtcaggaattcgagaccaacctggccaacatggtgaaacaccctctctactaataacacaaaaattagctgggcttggtagcgcatgcctgtaatcccaactactagggaggctgaggcaggagaattgcttgaacgccggggtcggaggttgcagtgagccatgatcgcgccactgcactccagcctgggcaacagagcgagactctca

SEQ ID NO: 367617 - DNA, 16165 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagctgcaggcattgaaaaaattgcacaacttcaactcgaatctagggaggaccaagaccaaactggcgtagtttcccttttgttacgaacagcaatagtgtactccggagtaataaggggagcccacaatgatgttcgttaacaaaagggaaatacgccactttgctgcatccagggctcaatggt

SEQ ID NO: 367618 - DNA, 8763 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggtgagtacaggctcttcaaaatatagtgaataaaaattgctctttgcttttggcctttggagatgcctccttatataattaaagtgaaaatcaaggttggatatgaaaacaaagggcatgcccaaagcagtcttcccctgcaacctgacctgtcaccccttttgctatataacattgctccattttgcaaaattccttcccatgatggaaaaagtaaatgaactagttgtcccacttagaactatcaaatgaacactgaataattaaaatgagattttcatcttgagaatttcccttttttgaatgtgtaaatgggatgggtaagcatcatctttaaacttgggcactggccagccacgaagtcagaagatcaaaaccagcctggccaacatggtgaaaccccatctctactaaaaatacaaaaattaggccaggtgcggcagctcacacctgtaatcccagcactttgggaggccaaggcaggcggatcacgaagtcaggagattgagaccatcctggctaacacggtgaaaccccgtctctactaaaaatacaaaaaattggccaggcgtggtggcgggtgcctgtagtcccagctactcgggaggctgaggcaggagaatggtgcggagcttgcagtgagccgagatcacgccactgcactccaacttgggcaacagacagagcgagactctgtctcaaaaaaaaaaaaaaatacaaacattagccgggcatggtggcacgcacctatagtcccagctactcgggagtctgaaacaggagaatagcttgaacctggtaggtggaggtttcattgagccacgacagtgcatgcactccagcctgggcaacagacagagtgagactccatctcagg

SEQ ID NO: 367619 - DNA, 14685 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaagactgtacgtcacatttagaggcagcgagagagtagcagaatccaggtctgagctccatatgccacagtgcccagcatcatatgctatgctggtatatagtctagtggctgtcagttcaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatagagttccatatgtgtatcaagctgttccctagcagtttcaggaagtcctcctgtgggcttagatgcagaaagctggctctccattctagtcagttccaagaagaaatattcaatttcactgtggaagcactggccctgctgcagagttgactgaaactgttgctccctctcatctgttttctgtacactgacttcagcattggttcatggttttcaaacggctccataagctgctgcat

SEQ ID NO: 367620 - DNA, 12844 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacaggtatgtgtgtgtctgacactcataaccttgaattgtctactgttctaaacaagaggtctctgtatcaggtatgtctctgtgctcaggaatgtccagagcagcatgttaatacgtgatcggtagatagaacagaaagcttagcctatcttcatttttattccaaggaacattggcatactgacattctaaggagagtgaaatgagtcttggctggtatatattgtctgttgatggtttctctgaaaa

SEQ ID NO: 367621 - DNA, 11917 bp, Homo sapiens
  misc_feature (995)..(995): n is a, c, g, or t
  misc_feature (1066)..(1066): n is a, c, g, or t
  misc_feature (1076)..(1076): n is a, c, g, or t
tcaaaacaccatctattaaagctgacaattgtcacaagcagaattgaatactcaaagggaagttaacttcacacagaaaaacacttcatatttcattcaacttgcaacgtatttactgagcgtctaccgtgtgtaaggcagcctgctaggaaatggggtacgaccctcctcctcacagagcttacattctgacaggggaacccgaagtgaacaagcatgatctgcaacaggtatgagatgtcaagaaagcctattacagaggcacccaggcccagtctacggggtcactaaaggctatgggataaactgatctgaaggatgagcacaaatcaatcatcgagaggctgagagcagctcaagtcgggggaataagatgtgcgagaagcaggagagagcaggatgaaataaaatcaggcccgtgtgatgcgtggtgaacagtgagtacccagagaagcgaagctgggggctgaggggctggtcaggaacacgggcttaattcatcaacccaacagcaaacatcagtgcaacaatgtaagcacatttaccttctgggtcataatgtaatttcttccaaagccagtggtggcactcagatatttgatcagaggattgacagattcaggcttttggtggaaaagccatacctggaaaggaaggatgtgtcaatgatttgtttcttctgcccaaggtgagtgaggctggtggagagtcactatctgcactttatagagctccccagacaaattataaacatcctctcaaatatcatcagtgaatggtttggcaaatatattgagaaccaattaaaatatagtttaaaagcacttgcttctacaaccaatttgtattcccacaataaatgtatttatttctgtaacacttaccaaaacaagagcatcaaagccaattccttcacactgccctccctcccacctgctcttcatgaggagtcctttattcctgcatgtttcctgttctttgggccggaattccgnggcgcgatgtcggctcactacaacctctgcctcctggattcaagcaattctgtacctcagcctcccgagtngctgtgattncagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaagcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaagagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgggccatcagctcctctgaagatgaaggcaatctccgatttgtgtatgaactactgtctttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggtattcatgtttccatttttattggttatgttattctgttattttgttattttgattcatgtttctcttcatttatttttttttcttcattacaaacacttcaactttattttatacacaagtgcatagttagtggacttgatgctgactgctaatctgtttttggatgagtccatggaaatacttatatttaacaagttaaatcagtaattctagaagatggtacagggtatatagtcaggggccatctgaactccaactcatgatttacattattaggtgatgggtcactaagattctatttgagcagttttatgaaagataatgtgctttaacaaaaccagatctatctgtgtagtgcccaggatttgatcatacagttaaaaaacttttaggatatttctggatttgttcaaattccggggattctgtgtcatcttaatagaagagtttgcctttttcatttcatttttatgaaatctgtttgggagagtaaaaataggt

SEQ ID NO: 367622 - DNA, 2078 bp, Homo sapiens
  misc_feature (71)..(71): n is a, c, g, or t
  misc_feature (99)..(99): n is a, c, g, or t
  misc_feature (102)..(102): n is a, c, g, or t
  misc_feature (130)..(130): n is a, c, g, or t
ggggggggggggatgggagaaggaagaggggggggggaaagggagggagaggaaggggggggggggggggntttaaaagggggagggggggtaaagaanaanaaaggggggggggggggggggggggggnaaaccaagcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccacctatgtcagccgggctgcggagccacaggaacaggagtttgggaagagcgcttggataagggactacagcagtggtggcagctccaggacccttgacgcccaggacagaagctttcccccccagaccgctgagctctgggttcagccccgagaagcccagcatcaggatgaggaattgagaaggattccagtgtggaaa

SEQ ID NO: 367623 - DNA, 19077 bp, Homo sapiens
  misc_feature (5955)..(5955): n is a, c, g, or t
taggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgnctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgcagctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatactcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaa

SEQ ID NO: 367624 - DNA, 1694 bp, Homo sapiens
  misc_feature (686)..(686): n is a, c, g, or t
  misc_feature (785)..(785): n is a, c, g, or t
ggcgcctgcactgggcctctggtcctgtgtaggggctgggcatggaggcagggcccggcgttccctgccctgtgcttacagtcagtggcgaggcagagacttcttaaacagaggcaccagatggaaatggaaggactgtgtgtggggcccagagtaacctcctaattcagctccagcccaacccaggaaggcttctggaggaggtggtacctgccccagctttccattcattctaagtggagaggggactgcagggccaaggaggggaaggaaaagtggtttctgacttggggagcagctgtggttgcctgtcacgaggtgggaacgctccaggagcacgcctggaggagatagcatgtcgagtttgaactgcccgtagatgtccatgtgtgggctccctgaaggcaggacccacactcctgttgtgatcactgctgtgccccagagcccatatgcagacctggcccagagctggcaccgggggtctgctgccatgggggagaattccaagggaggtgcccagcaggtggactggattctaggactggagctatgggtagggaatggagtccagggcacaccccactaggctgatgctgcttccttgcggccccctacccccctagaacaaccagctggaaaagatctaccctgaggagctctcccggctgcaccggctggagacnctgaacctgcaaaacaaccgcctgacttcccgaggcacctgtaatccgagctactcaggaggctgaggcagaagaatcacatgaacccgggaggcggangttgcagtgagctgagatcacaccattgcactccagtctgggcaataagagtgaaaaaagctgtctaactaaagcaagctcctccaacaagaccaagacagcatctctccttctaaggcttaggatttgcccagaattcctgatacctggactagcccataccaacagtcatggctcctataacaaagccttgaactgccacatgcatgtggatcagatgaagggacattgtcgtgtttcccatgctcttcaatttgtgtaatccctatgcaacaatggctgcaaagcctgccattccaatgggacaaatggtgcctctttagctttctgaagaagtttggatccctgatcttcatcatgtgaaaaatgggaaacctctgtgtctattgacatagtgattggttgaagaatctccctagagtgagaaaacctcttacacgccaaccagcttctgatccctcccgtgcaccccaggcgggtgtttctaagacctgggggatgcgcaggagagaggcttcagagaagctgagcttccagaaccttgtcacaggatcttcggttccgagggcctttagaacccaagagttgtagagtcctcacattttaaaaagatttttttttcctgatgacgaaaataacatctgactgggatagaaactttgtaacataaaatggaaagagaaaatttctcataattttgccacttggaattaactactattgacattttggtaaatttgtttccatttttaaaaaagcagctttcttgaagtatcatttatgtaccgtaggatttacccaatttgaaggtataattggctgagttttagtcagcggtgcagccagcaccacagtccagtggtcttttttcctttgtgttttaaactcgtggctgaacacatgctatga

SEQ ID NO: 367625 - DNA, 3058 bp, Homo sapiens
  misc_feature (528)..(528): n is a, c, g, or t
agcttgacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacnctgaacctgcaaaacaaccgcctgacttcccgagggctcccagagaaggcgtttgagcatctgaccaacctcaattacctgtacttggccaataacaagctgaccttggcacccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcaggtgggagtccctgactcccttggtcacccctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367626 - DNA, 2426 bp, Homo sapiens
ctaagacactgatggggcccctccctctcttatgatctctgtggatgtaaatctgctttcccgtgagggcagtggggtgtagggatcttattatctcctcagccccactggtagttcctgaggattcctacttaggcctccttcctaaataccctgttacttttcttgccctggcctactcacccctacccccgtgtgcacttagaacaccatgcctgctctaaccggacatgccacacatttcagacgcccacaaagcctagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcaggtgggagtccctgactcccttggtcacccctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367627 - DNA, 742 bp, Homo sapiens
  misc_feature (35)..(35): n is a, c, g, or t
  misc_feature (37)..(37): n is a, c, g, or t
  misc_feature (57)..(57): n is a, c, g, or t
  misc_feature (63)..(63): n is a, c, g, or t
agttatttcaaaaaggtggctggcaggttcttccntnttgcacaacacatacattcnttaccnattctttggaacccacaatgcacttgctgggcaaacaaggaaaaacacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367628 - DNA, 3004 bp, Homo sapiens
  misc_feature (528)..(528): n is a, c, g, or t
agcttgacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacnctgaacctgcaaaacaaccgcctgacttcccgagggctcccagagaaggcgtttgagcatctgaccaacctcaattacctgtacttggccaataacaagctgaccttggcacccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcaggtgggagtccctgactcccttggtcacccctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcatccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367629 - DNA, 2945 bp, Homo sapiens
  misc_feature (528)..(528): n is a, c, g, or t
agcttgacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacnctgaacctgcaaaacaaccgcctgacttcccgagggctcccagagaaggcgtttgagcatctgaccaacctcaattacctgtacttggccaataacaagctgaccttggcacccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367630 - DNA, 1386 bp, Homo sapiens
ggcccgggagtatgaaggtagagctggttctctgaggtgttgtcctcacacagagttggggtgggtgacagggtgactggccatccagtggggacaccacaggcctcatgaggggctgtggagtcctggggtgggtgagaatctgccccatctcaggtcagttgagtggggctctgggagaagccctggggagtggctggtgggacccaaaggccttctggcaccccgctggctctgggctcccagggccaacgctccctccctactcatagtagcctggcctttccagagccccctccagcagggctccccacagcaggtcccctcgggctgcttgggctggtgggtctgccctgagctggcccctgactctcttacatgttccacaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367631 - DNA, 712 bp, Homo sapiens
agcttgacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtg

SEQ ID NO: 367632 - DNA, 1499 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367633 - DNA, 712 bp, Homo sapiens
acgctgtggatagtaagactgctgtgggggtgaagggaaggggtatgaaggctgctggggtccgaggtatgaagcctgtccaggactctggtgatacactggtggatatggcatattatactggccatacgcataaggattatagcccatgggcatgggcatttggcaatacccaggatatcctggataggtgggatagggtggtccctgcgcctgtggaggaggagctgagccaggcgtttgtgatggagctggcgcagcagtcccagcccccactggagatggagcagtagcagaaggagctcgatttgctggaagcacaggtggtggaggcgtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367634 - DNA, 1904 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccacaaaaaaaaaaaacacaaaacacaacacaacaaaacatgtgtggggcgcacacagcgcccccagaaaaaactcttaaaaaaccaatcggtggggggcgcacgcgcgcccaaaaggcacaagcgaaccaggcgccacaaccgcggggtccccagagagaacaccgcggggcacaaacaagacgtgcgcggtgggagttcctccacccacgacagtaataaaaaagaggacgcccgccgggggggaaaaaacacagagggaggctgtacatgaggacaacaacaacgccagacaaaggagggacctgaggcgcggacacacacgaggggggggacatacaaccaagaaggagcacgctccacaagcgagcgcgcggaacaaccaaatattagacgcccggcggtctggg

SEQ ID NO: 367635 - DNA, 1431 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367636 - DNA, 1591 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367637 - DNA, 1901 bp, Homo sapiens
ggcttgtggaagcgtcaccttgtcctccttgcatcacgtctgtgcccacatttccccttctacacagacgccaagcagaatttagggcccaccctgacaacccctttttacttcactttattattttatttgcttattttttgagacagggtcttggtatgtcgcccaggctggagtgcagtggtgcaatctcggctccctgtaacttccccctctcgggttcaagtgattctcctgcctcagcctcccgagtagctggtactacaggcacgcgccaccatgcccagctaatttttgtatttttagtagagacggggtttcgccatattggccaggctgctctcgaactcctgacctcaggtgatcctcccacctcggcctcccaaagtgctgggattacggtcttgagccaccgtacccggccctctttatttttgagacaggatcttttgtttccgaggctggagtgcagtggcgtgatcacagctcactgcagcctcaacccccttggctcaagcagtcctcccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtaggaccgaccacaggtgttccatccccaggcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367638 - DNA, 1408 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcactacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367639 - DNA, 1366 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367640 - DNA, 1250 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaagaaacaccaagggacccacgacaggcctgccccgcatcgcagggcatgctgcgagccatggacagccgagaaatacaaaagtaaatgcacttgttcaacgtgcccgcgccgtcctcacagcaccatcgcgcagcacatggccagctgcgtcaccgcgcaggccccttcacatgcaagggcgcaacccacgccccggagggtgaacagtctgggggttcacagtgccggggtaaaggtgaagagctcagggcaggcgccagggcgctcaggaaggggctcaggccgcggggaggcctccgaggaatgtggtggcgacgggcctgcctttggtacgggagcagcgcgtcgggggagccggccgggcggcgtttccgagaacggggttcggcgttgtcagcgtctagtcagcaccaagcgggtggaggcaggcgcgggcctggggacgagatagcaccggggcaggctgtggcgaatccgctggcgggcccgccctgcagacacgtgt

SEQ ID NO: 367641 - DNA, 716 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcactacgagttcatgcggagaagcctcatcttctacaggaacgaaatccggaaggtgacgggcaagagattgccacaaccacctcaaccttcagcaagcatcatcctgatcagtcagcagccatcaa

SEQ ID NO: 367642 - DNA, 559 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgagcgggacccgggagaccgagacagtgccaggggcgggaggccggggccggggtctgggcgggggtgccggaggccggagtccgggtcggggcgccgggga

SEQ ID NO: 367643 - DNA, 1809 bp, Homo sapiens
ggcttgtggaagcgtcaccttgtcctccttgcatcacgtctgtgcccacatttccccttctacacagacgccaagcagaatttagggcccaccctgacaacccctttttacttcactttattattttatttgcttattttttgagacagggtcttggtatgtcgcccaggctggagtgcagtggtgcaatctcggctccctgtaacttccccctctcgggttcaagtgattctcctgcctcagcctcccgagtagctggtactacaggcacgcgccaccatgcccagctaatttttgtatttttagtagagacggggtttcgccatattggccaggctgctctcgaactcctgacctcaggtgatcctcccacctcggcctcccaaagtgctgggattacggtcttgagccaccgtacccggccctctttatttttgagacaggatcttttgtttccgaggctggagtgcagtggcgtgatcacagctcactgcagcctcaacccccttggctcaagcagtcctcccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtaggaccgaccacaggtgttccatccccaggcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367644 - DNA, 1471 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctgccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367645 - DNA, 1037 bp, Homo sapiens
tgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 367646 - DNA, 722 bp, Homo sapiens
agctcactgcagcctcaacccccttggctcaagcagtcctcccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtaggaccgaccacaggtgttccatccccaggcttcattgaggaccctgagaggaagtatcactttgagtgcagcagcgaggagcagtgtcaggagtggatggaggctctgcgtcgggccaggtggggccaggcggtggtgggcactgctggggtgggcacagcagccatgcagagcgggcatttgaccccgtgccacccttttccccagctacgagttcatgcggagaagcctcatcttctacaggaacgaaatccggaaggtgacgggcaaggtgtgtgcagggctgcagagggccggggtggggctgcaggtggcagaggcagtcctccagcc

SEQ ID NO: 367647 - DNA, 317 bp, Homo sapiens
tcatggctgtggagaacagatcctgcatgccttttgtcttctgtgagcatctgccactctggtatggccaccaaatgctcttctccctggtgcatgccagggagctttgcgcacagcattccacagatagcatggactagggaacacaccccaggtggacatgtgacaggcagaagacttgtgcagcgtgctgttcagggcgagtgtgcaaagacaggccacctcttggggagacggcccatagcgcggaaagaagtcatcttcctttccggccattctctttttctctacacacgagccctgcaataggactcagt

SEQ ID NO: 367648 - DNA, 5762 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagtccctcggggaccattcctgggggagatgcagcttttctatacgaattccttctacaaggccatacatctgagcccagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367649 - DNA, 415 bp, Homo sapiens
cctctgggacacttttcccaagaagcttggggacagcacgagattcccacattggccggcaccatgctgacaaattcgtgttctctggtgccccctacaggaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctgtaagtattgactgacggccggtcacctggcttagggcccaccaccacgtctatcgtatgtatgcgcgtgcgcgcgcgcgcgcgtgtgtgtgtattttggggatgtgtgtgaagccattgtattataacctgaaac

SEQ ID NO: 367650 - DNA, 391 bp, Homo sapiens
gctgggcacagtggctcatgcctgtaatcccagcactgtgggaggccaaggtgggaggatggcttgaacccaggagctcaagaccacctgggcgacagagtgagactccatctcagggaaaaaaaaaaaatgtagaaattttagcgcgtctcaaatgcatttttgttgtttgctcccagggagtggctttacttgctgtgccatgaaatgctgaatccttattacgggctcttccagtattctacggacaatatttacatgttgcaaataaatccggattcttcaatcaaccccgtaagtatgaatgaacaaagaggtagggaattgagttggagaagttttgagatggattttcagtttcattctcagtccttggtctatttgttgtaga

SEQ ID NO: 367651 - DNA, 5684 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367652 - DNA, 5540 bp, Homo sapiens
ggctccttgattcattttgtcttcaatgaaaagtccgtgtttcctgggtggctctgtagtgccaccttcaaggaattcaaggtctaaattgacatatttgggaagagcagggtgttggggaaacagaactgctgagaagctgccattgatggtgaaagactttaatctaaatttagattctcttcagaggtttcgtggaatacttccttaaattaagccacagactgcaaaagctgctgctgagtggggcttccagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367653 - DNA, 5341 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367654 - DNA, 3393 bp, Homo sapiens
tgttgtttttttttgagatggagtctctgccaaaatatttttgtcatcatcagaactcaaaagccacagcactcactgcctgtccttggccttgaggttggtcctagggctggactgcccacacggtgactctcttttgtcctttttcagctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367655 - DNA, 4041 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagaacttgttaggtttttccatttgttcaaccctcgggcggatcacgaggtcaagagtcggaggttgcagtgagctgagatcgcgccactgcactccagcctggtgacacagcaggactccatctcaaaaataaataaatatcaattaataaataaaaagtctacttaaagaaataattcaagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367656 - DNA, 3109 bp, Homo sapiens
  misc_feature (123)..(123): n is a, c, g, or t
atagtgttgtgacggtcatcaacctgccaggctagtcacatcttcgtgtctagcacgtgcgctcgtagggttcgatgacatcgaaacctgtgtatcagccctcaaaataggaatctagactgngtttagggtttgatgaagggtttgatgacggtcatcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367657 - DNA, 2574 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagaacttgttaggtttttccatttgttcaaccctcgggcggatcacgaggtcaagagtcggaggttgcagtgagctgagatcgcgccactgcactccagcctggtgacacagcaggactccatctcaaaaataaataaatatcaattaataaataaaaagtctacttaaagaaataattcaagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacagccggggccctgccgcgcctggtcgacgc

SEQ ID NO: 367658 - DNA, 2560 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagaacttgttaggtttttccatttgttcaaccctcgggcggatcacgaggtcaagagtcggaggttgcagtgagctgagatcgcgccactgcactccagcctggtgacacagcaggactccatctcaaaaataaataaatatcaattaataaataaaaagtctacttaaagaaataattcaagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagtccctcggggaccattcctgggggagatgcagcttttctatacgaattccttctacaaggccatacatctgagcccagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaagtaagactttaaaaatattttttgctgacctctttcattggtaatcgaatgctttcttggactggtatttttgtgaatttattgactgtcttgctggttggataataagcatggtcaaaatgatgttaaatatctggcggataattgcatattttaaactcttaaattagctgtgaagagcactgaagccctatgttgttgctacccttttcttacttgcagcctacataaaatttaccgagatggcagtattaggcggctgcacgaaggaagtttccgcacgcagcgctctcatgagacacgtggcccttaggttgagaagtagagatacgtgctatccccctagtgcctgcacggtggggaactggataccttggaactgggaattatcttggatcccatatttagtgttccaggcctgtcgtgttctcagagccaaacattccacatagctctttttttttttttttttgagacagagtccagctctgtcacccaggctggagtgcagtggcacaatctctgctcactgcaccctccacctcctgggttcaagtgattctcctgcctcagcctcctgagtagctgggattacaggcgcccgccaccatgcccagctaattattgtatttttagtagagatgggattttgccatgttggccaggctggtcccaaattcctgactgcgggtgatccgcctgccttggcctcccgaagtgctgggattataggcatgagccactgcgcctgcccccgacatagctcttttaaccgacagctctgtgtctcagtggcaaaacttgaacaggacaaatgccactttgtcaccgtactaatcctactccttttactgaaattttgctctcaatgagcaggtgtagaaatctcttggcggtaaaaatgagggatggttttcattagatttcactcgagcggtctgctgttgtgcctatcatgagatttcatttgagttctccactgttacctcctttaaaatttttt

SEQ ID NO: 367659 - DNA, 2212 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagaacttgttaggtttttccatttgttcaaccctcgggcggatcacgaggtcaagagtcggaggttgcagtgagctgagatcgcgccactgcactccagcctggtgacacagcaggactccatctcaaaaataaataaatatcaattaataaataaaaagtctacttaaagaaataattcaagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctgtaagtattgactgacggccggtcacctggcttagggcccaccaccacgtctatcgtatgtatgcgcgtgcgcgcgcgcgcgcgtgtgtgtgtattttggggatgtgtgtgaagccattgtattataacctgaaac

SEQ ID NO: 367660 - DNA, 404 bp, Homo sapiens
cccactttaatagaaatttgaatgtaagcctttttttttttcagtcactttcttttctaccctctaaaaatctgagtatggaggcatactaggctctcttagaaagctcaatagacataacttattttgctgattgaaattatcctgaaattagagaacacgaattgtgtgttctgtgtcacatggatggatgtgaggtctcatctaggtgtgggtctcctctctcctctagggctccctgacccttttgcaaagattgtcgtggatgggtctgggcagtgccactcaaccgacactgtgaaaaacacattggacccaaagtggaaccagcactatgatctgtgagttgaatgttctgtaagccccatgcggagcggcaggaaagcaggtgtctaccttttacg

SEQ ID NO: 367661 - DNA, 365 bp, Homo sapiens
ccaggagtttgagagcagcctgggcaacctagcgagaccctgtctctaccaaaaagcaaaaacaaattacaaatctttgtattagaagcagaaaaacacaggggacatggagaactcatcaccaaccctgccccaccccccattcctctcccctcccacatatacttctcactgcctgtccttggccttgaggttggtcctagggctggactgcccacacggtgactctcttttgtcctttttcagctttaaccggatcgacattccaccatatgagtcctatgagaagctctacgagaagctgctgacagccgtggaggagacctgcgggtttgctgtggagtgaaaagcaaccaaaggcaaca

SEQ ID NO: 367662 - DNA, 5865 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagaacttgttaggtttttccatttgttcaaccctcgggcggatcacgaggtcaagagtcggaggttgcagtgagctgagatcgcgccactgcactccagcctggtgacacagcaggactccatctcaaaaataaataaatatcaattaataaataaaaagtctacttaaagaaataattcaagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367663 - DNA, 4487 bp, Homo sapiens
ttgaggcagatctgtgttcaggcctaggcacttgcggcctaggcacttgcagctgagactatgtgggcacgtctgtgtgccacgctgtcctgtgctgtactttcaaatgtacttttacacatttaaacaatttttaaatttttacatggtcttgctatgttgccaggctggtctcgaacccctggcctcaagcaatcctcttgcttccgcctcccaaggggctggcattgcaggcgtgagccgccatgcctggccagaacatgctttcacattgcagcaattgatgtgacagatcaggttcaatcctcctgttttcgcgagcaaatcggaatgaatcagggcacgtgctgagtcatttttaacgtgatgccaaggtttggtactactagctggtggtgtgtttgtctgtcttggagagatccggggagtggggggctcagtgtgttcccatgtttgtcagactgtgatatcagaacctgctcacaggtcgggcgcagtggctcatgcctgtaatcccaacactttgggagaccgaggcgggcggatcacctgaggtcaggagctcgagaccagccatggccaacatggtgaaaccccatctccactaaaaatacaaaaattagccaggtgtggtggtgggtgcctgtaatcctagctactggggagggtgaggcagaagaattgcttgaacccaggaggctgaggttgcagtgagccgagattgagccattgcactccagcctgggtgacagagtgagaccctgtctccaaaaaaaacctgcccatggcggaaaatccacttggtgttgcatccaacttgcgagtttttcttccaggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367664 - DNA, 3452 bp, Homo sapiens
aggcccaagacttactttactgtgtgttgattgggcacagtggctcccagcacgttgagagggcaaggcaggaggttcacttgaggccaggagtttgagagcagcctgggcaacctagcgagaccctgtcttcactgcctgtccttggccttgaggttggtcctagggctggactgcccacacggtgactctcttttgtcctttttcagctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367665 - DNA, 5081 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccaccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 367666 - DNA, 5095 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtgatttgggctgtcgtgcggatgaaggaccagggtgacaagcgaccgggagatcgtgtcagtggacatgcatccaccgaacaacccctcaccaggactaagctgcggcgggagcgccacgaatctcccagtaagaaccttgaaaacaacggccaggc

SEQ ID NO: 367667 - DNA, 1204 bp, Homo sapiens
cgcgcgcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagaacttgttaggtttttccatttgttcaaccctcgggcggatcacgaggtcaagagtcggaggttgcagtgagctgagatcgcgccactgcactccagcctggtgacacagcaggactccatctcaaaaataaataaatatcaattaataaataaaaagtctacttaaagaaataattcaagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaagggtacgtataaccacagcaagaggcgggctgagttctctgctgccttaacctctcggcctataggaaagcgcccttccctccttaagtcactctgcagaatgcttgagatgcataaaggatgttgggataaaactgtgaaccagtttacttggctataaaggaagctgtaaatacaaccgcagttgaagacgcagggcgt

SEQ ID NO: 367668 - DNA, 918 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtga

SEQ ID NO: 367669 - DNA, 1002 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatggtgaggcggagggagcgggtgatgttagaaggcgggcgaggaatggctccaggactaacccctggcacctccccctccccacagtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtga

SEQ ID NO: 367670 - DNA, 944 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgagcgttcagctggtactggggaggtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtga

SEQ ID NO: 367671 - DNA, 1164 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcggtgagcgccggggtcttccccggcaggtccacctgttcccagcgtggccccgccctgccccctgcctctgtgatcggactccctgttcgccctccgctgcacctcaagtgatcctgactctcatgtcctgcccatccccaaagagagtcctgtcgtcatatcctccgggatcaccctgccctctcctcccaatcttgtctggaatccttccgtgaccccctttcccccacactcgccctctcgtagtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtga

SEQ ID NO: 367672 - DNA, 863 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtga

SEQ ID NO: 367673 - DNA, 925 bp, Homo sapiens
ctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatggtgaggcggagggagcgggtgatgttagaaggcgggcgaggaatggctccaggactaacccctggcacctccccctccccacagtaacaacatgctgtaccccaaggaagacaaggagaaccgcattctgctctacgcggtgagcgccggggtcttccccggcaggtccacctgttcccagcgtggccccgccctgccccctgcctctgtgatcggactccctgttcgccctccgctgcacctcaagtgatcctgactctcatgtcctgcccatccccaaagagagtcctgtcgtcatatcctccgggatcaccctgccctctcctcccaatcttgtctggaatccttccgtgaccccctttcccccacactcgccctctcgtagtgccggaactgtgattaccagcaggaggccgacaacagctgcatctatgtcaacaagatcacgcacgaagtggagtgagtggcgggccctgagct

SEQ ID NO: 367674 - DNA, 1007 bp, Homo sapiens
  misc_feature (944)..(944): n is a, c, g, or t
  misc_feature (947)..(947): n is a, c, g, or t
  misc_feature (962)..(962): n is a, c, g, or t
  misc_feature (979)..(979): n is a, c, g, or t
  misc_feature (987)..(987): n is a, c, g, or t
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtgaaaaaaaaaaaaaaaactttcatccgncanctcatgatatattcnaccggaattccgaccgnacctgagngtacactttctttatggcga

SEQ ID NO: 367675 - DNA, 1077 bp, Homo sapiens
  misc_feature (963)..(963): n is a, c, g, or t
  misc_feature (984)..(984): n is a, c, g, or t
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtgaaaaaaaaaaaaaaaaaaaaaaaaaaaaaaaaaaaaaaaaaaaaanaaaaaaaaaggggggggggcnaaaaatcccccgcgagggggccacaagttgtgaggcacgaccaccacggttttgtagctaaacacagaggggtgcccgccccaagtaggggca

SEQ ID NO: 367676 - DNA, 1248 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatggtgaggcggagggagcgggtgatgttagaaggcgggcgaggaatggctccaggactaacccctggcacctccccctccccacagtaacaacatgctgtaccccaaggaagacaaggagaaccgcattctgctctacgcggtgagcgccggggtcttccccggcaggtccacctgttcccagcgtggccccgccctgccccctgcctctgtgatcggactccctgttcgccctccgctgcacctcaagtgatcctgactctcatgtcctgcccatccccaaagagagtcctgtcgtcatatcctccgggatcaccctgccctctcctcccaatcttgtctggaatccttccgtgaccccctttcccccacactcgccctctcgtagtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtga

SEQ ID NO: 367677 - DNA, 1214 bp, Homo sapiens
agccaatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatggtgaggcggagggagcgggtgatgttagaaggcgggcgaggaatggctccaggactaacccctggcacctccccctccccacagtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtgaaaaaaaaaaaaaacgaaaaaatgttgttgggcgccccgccccgaggaaaattttcgaaccatgcgttggggccggggccccagggttagtagacacggggcctacgggtcccaggaaacccgcccgagaaaggtggtggtttcccaataaaaagcgggggacaccgggttgaacatccaggggttgggccccggctccaagggccgagcgta

SEQ ID NO: 367678 - DNA, 721 bp, Homo sapiens
gacggatttcacccttggcatccaggctagtgtgcagtggcgcaacctcagctcactgcaacctccacctcccaggttcaagcgattctcctgcctcggcctcctgagtagctggaattacaggtgcccgccaccacacccggctaatttttgtatttttagtagagacagggtttcaccacgttggtcaggctggtcttgaactcctgacctcagatgatctgcccacctcggcctcccaaatgctgggattacaggtgtgagccaccgcgcccggccaagtaacaatatttctggatataatacctgaaaactcagcgcagaaagatataaagggataaaaaatttataatatagtcattacaatggaataaaatgaaatataaagcaataaaaaggaacggacagctgatatatgtaacaatatggatgaatctcaaaagcaatatcaaaagatcaaaagggtatatattacatgattccattctggaaaaggcaaaactatagggacagaaaacaagtcaatgataggcagtgggccggggggggaagtgatttattataaagaggcatgaggaaactttaggatgacataaatgttctatgtctttatatggtggtgggtacatgactgtatacttttgacagaggtatatctaaaaggggtgagttttactgtgtataaattatacctcaatgaacctgactaaaaaaaaaaaga

SEQ ID NO: 367679 - DNA, 2302 bp, Homo sapiens
tacatggagaaaggctcaatagaaatgcaaacgtgtgtgctagaataaagaagttattggtggttttacttttgattatcccgtaaatttttttaattttaaattattctttttaaaaatgtcttctactaatctttaaacattattaagtagtgagaaatattatttctactgatttataaatatatccattcttcacattcacagtgggatttgtaaaagcaatccttggatttacaacctttttttttttttttttagcaaacaaagctctcaagttggtgatcctcaggtaacatctaacctacagatattgcaccagttatttattgctacaaaaatgctgcctaagaagccacccaaagggcagtgggttacaacaataactataccttttttcttaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtaagcttaatcatgttctcatattgaagcagaaactgtttactcatttatctatttacttactgggtctcctgggcactaggtactgtaataaagaactggagaaatacagtcagatgggaagtagcccctgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatgtaagccttcatttttagacatctaagccc

SEQ ID NO: 367680 - DNA, 1933 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagaaactcactctgtcactcaggctggagtgcaatggcacgatctcggctcactgcaacctctgcctcccgagttcaggagggctctgagagatttcatttctgtcctgctgatgaagtctacgttcattcagggcctgctgtggaagaccagccccaaaggaatgagactacatacactaaaaaaccaaaaagcctaaaaaaagagatgatattttaatttcaaaagcttaataatttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367681 - DNA, 800 bp, Homo sapiens
gggatgttggaatttctaaaaactaaacaagacactgttgaaatccattttgtcactttggttcatcagattcattactcttgatacatatgatggcaactggcttgttgacagtgttttcttaaaacgttctgtctgagccctatatgctgctctcaagaagacattacagtttattatgctattttttcatttagcattttctgcaggacaacttactggttctttaatttctgaagtgtagacacttgtttttcagtgctactaaatttagtcaaaacaaaatttctttgattaaaaacagtattttaattaaattttcttcaggctgggcatggtggctcatgcttgtaataccagcacatgttggccaggatggtcttgatctcttgacctcgtgatctgcccgcctcggcctcccaaagttctgggattacagacgtgagccaccatgcccggcatatatgaagttttaaaaaatcagaatacagaacaaaatttattgggagatgagcttctttctttctctcttcaacaccatcgccacatcacctccacatatacacacactgaaaagatactgaaaagacataataaccatgggaaatggagattactggattgttaaatgttctttttgcctgtctttattctctaactttgctataatgaacagaaattattttttgataagcaaaaaatattttaaatttaaacatgtaaagtaacttagtagttgtcttttcaaaatatgtaagaatcattagttcactagttggttaaatatgtttttaatccca

SEQ ID NO: 367682 - DNA, 331 bp, Homo sapiens
ccgggttcaagcaattctccacctcagcctcctgagcagctgggattacaggggagaaagggacatgctgctgctgatatacaacaggcagaaacaaatgatgccagatgtcctgtatcttgcacggttgttccacatgacagaactatctggctggcaattctactagactttgctagtctgtttatgctttcctactctccaaattgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367683 - DNA, 298 bp, Homo sapiens
tctcccatcacaagcctggatatctaggaggaaaaaatggttttgtgggccaggctcagagccccactgctctgtgcagcctcaagacggggtgacctgtattgctgttgcttcagctccacccatggctaaaaggggtcaaggtacagctcagaccatttacacactctttctctcctgctgccatgtaagacatgccttgctttcccttaaccttctgccatgattgtaagtttcccgaggtgtccccagccatgtgaaactgtgagttaattaaagctcttttctttataaatta

SEQ ID NO: 367684 - DNA, 3008 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtaagcttaatcatgttctcatattgaagcagaaactgtttactcatttatctatttacttactgggtctcctgggcactaggtactgtaataaagaactggagaaatacagtcagatgggaagtagcccctgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatgtaagccttcatttttagacatctaagccc

SEQ ID NO: 367685 - DNA, 3004 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccaggcaagcgcgcgcctcactgtaccggagagctccaagcacgcgcttggtctggggcccggacgctacatctgggaagggttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatgtaagccttcatttttagacatctaagccc

SEQ ID NO: 367686 - DNA, 2159 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagctcatagatggaaggcttgtctcagataagactttggacttggacttttgggttaatgctggaatgagttaagactttggggttctgttgggaaggcatgattgtgttttgaaatgtgagaaggacaagagatctgggaggggccagggttggaatgatatggcttggctctgtgtccccacccgaatctcatctcaaattgtaatcctcacatgtggaggaaggtacctggtgggagctgattggatcatgggggtggttcccccaagctgttctcatgatagtaagttcattctcatgagatctgatggtttaaaagtgtggcatttacacactctttctctcctgctgccatgtaagacatgccttgctttcccttaaccttctgccatgattgtaagtttcccgaggtgtccccagccatgtgaaactgtgagttaattaaagctcttttctttataaatta

SEQ ID NO: 367687 - DNA, 2214 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagctcatagatggaaggcttgtctcagataagactttggacttggacttttgggttaatgctggaatgagttaagactttggggttctgttgggaaggcatgattgtgttttgaaatgtgagaaggacaagagatctgggaggggccagggttggaatgatatggcttggctctgtgtccccacccgaatctcatctcaaattgtaatcctcacatgtggaggaaggtacctggtgggagctgattggatcatgggggtggttcccccaagctgttctcatgatagtaagttcattctcatgagatctgatggtttaaaagtgtggcatttacacactctttctctcctgctgccatgtaagacatgccttgctttcccttaaccttctgccatgattgtaagtttcccgaggtgtccccagccatgtgaaactgtgagttaattaaagctcttttctttataaattaaaaaaaaaacccaagggcggccgctctagagtatcctaggagggcccaagcttac

SEQ ID NO: 367688 - DNA, 1900 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367689 - DNA, 1910 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagagggctctgagagatttcatttctgtcctgctgatgaagtctacgttcattcagggcctgctgtggaagaccagccccaaaggtgtgttatactaagtaggcagattctatctccatctaattcctaagttaggcttttcttactcctagagttctgtatagcatggccttcttatttcttgtaacattgcttttgggaataaaatgtttgaagaaa

SEQ ID NO: 367690 - DNA, 2037 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagaaactcactctgtcactcaggctggagtgcaatggcacgatctcggctcactgcaacctctgcctcccgagttcaggagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367691 - DNA, 2204 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagtagagatgcggtttcgccatgttggccgggctggtcttgaagtcctgacctcaggtgattcacctacctcagcttcccgacgtactgggtttacaggcatgagccaccgttcccggccaaggagggctctgagagatttcatttctgtcctgctgatgaagtctacgttcattcagggcctgctgtggaagaccagccccaaaggagaagttttgctctgttgcccaggctggagtgcagtggtgcaatctcagcttactgcagcctctgcctcccaggttcaagcaattctcctgcctcagccacctgagcagctgggattacagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367692 - DNA, 2159 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagaaactcactctgtcactcaggctggagtgcaatggcacgatctcggctcactgcaacctctgcctcccgagttcaggagggctctgagagatttcatttctgtcctgctgatgaagtctacgttcattcagggcctgctgtggaagaccagccccaaaggagaagttttgctctgttgcccaggctggagtgcagtggtgcaatctcagcttactgcagcctctgcctcccaggttcaagcaattctcctgcctcagccacctgagcagctgggattacagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367693 - DNA, 1564 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccaggcaagcgcgcgcctcactgtaccggagagctccaagcacgcgcttggtctggggcccggacgctacatctgggaaggggtgggtggctgggtagataggcgaggaaggatcgtctctaccctctctcaagtagctgaggcctccgaaaccttccctagctggatttggggacagaggagcgctgttaaagctgatacattcctgtgggtcaactatgcaactaactcagattttgaggtgaataacaaatctctttatctatagatgataagtttaaattgtgatgcaaataaatttttctttcaaatggtgtgaatgttgaatctaattcagtcctgctaattttgtttaaaaagcatttgaagcagatggaactggaaagcctacttctgtaaattccatttactcattcatgcattgctttcattcaagaaatgtttattagtgtctaccatatactttgctagttactggggttatgaggggatatggcaataaacaagaaagacaatgtctattgcctgaagaagtaatacca

SEQ ID NO: 367694 - DNA, 1269 bp, Homo sapiens
cgcatgttcccagtcctaatatacattatgtgataagacacaagtaaatcatcctgaagttaagtctttaatgagaaatgcaaataaagcatttctcaataaattatgggaagagaatcaactgaagaataaacatctttagtaaatctttggctcgtgtgcattaaccaatactcttgaaaaccaggattaatttactgtaccttcttaatattcctttgaaattccttatggcgcacaggtagcgtagaaaataactgcttcacgctgactgtggtccctctggagagggggtagggggtattctgggatgattttcccatcgtgatcaaacaccagtcgagtcccaaccttcgccgatacgtggcaggtagaaatggtgacatcattaagccttcgaagttttcttcttctaccccacatccattgcctgaaacttcaatgagatccattccatagtccttaagctttagattaactcttaggtgacaaagccaggattgaagctcatgcggtctggctccagaacaactcttcttcatagttacgttatactgcccctgcattgttggtattgaaaataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagctcatagatggaaggcttgtctcagataagactttggacttggacttttgggttaatgctggaatgagttaagactttggggttctgttgggaaggcatgattgtgttttgaaatgtgagaaggacaagagatctgggaggggccagggttggaatgatatggcttggctctgtgtccccacccgaatctcatctcaaattgtaatcctcacatgtggaggaaggtacctggtgggagctgattggatcatgggggtggttcccccaagctgttctcatgatagtaagttcattctcatgagatctgatggtttaaaagtgtggcatttacacactctttctctcctgctgccatgtaagacatgccttgctttcccttaaccttctgccatgattgtaagtttcccgaggtgtccccagccatgtgaaactgtgagttaattaaagctcttttctttataaatta

SEQ ID NO: 367695 - DNA, 1011 bp, Homo sapiens
cgcatgttcccagtcctaatatacattatgtgataagacacaagtaaatcatcctgaagttaagtctttaatgagaaatgcaaataaagcatttctcaataaattatgggaagagaatcaactgaagaataaacatctttagtaaatctttggctcgtgtgcattaaccaatactcttgaaaaccaggattaatttactgtaccttcttaatattcctttgaaattccttatggcgcacaggtagcgtagaaaataactgcttcacgctgactgtggtccctctggagagggggtagggggtattctgggatgattttcccatcgtgatcaaacaccagtcgagtcccaaccttcgccgatacgtggcaggtagaaatggtgacatcattaagccttcgaagttttcttcttctaccccacatccattgcctgaaacttcaatgagatccattccatagtccttaagctttagattaactcttaggtgacaaagccaggattgaagctcatgcggtctggctccagaacaactcttcttcatagttacgttatactgcccctgcattgttggtattgaaaataactgataccgtggttccagaagatttttctaacagtgtttgcaagctataaaatagtgctttcacttagaaaaggcatgagccaccgttcccggccaaggtggctgtagctaccttctgcatatggatatccagttttcccagcaccacttattaaagagactgtcttttctgcagtgtatattcttggcaccgttgttgaaaatgaattcattgtaggtgtgtgggtttgtttctgggttctctattctgttcaacttgtctatgtgtctgtttttatgccagtaccgtgtcattttagttaccagagctctgcagtataatttgaaaccaggtcatgtgattcctccagttttgtggtattaggataggtttggctattctgagtcttttgtggttccatataaattttagaattttttttttcta

SEQ ID NO: 367696 - DNA, 1131 bp, Homo sapiens
cgcatgttcccagtcctaatatacattatgtgataagacacaagtaaatcatcctgaagttaagtctttaatgagaaatgcaaataaagcatttctcaataaattatgggaagagaatcaactgaagaataaacatctttagtaaatctttggctcgtgtgcattaaccaatactcttgaaaaccaggattaatttactgtaccttcttaatattcctttgaaattccttatggcgcacaggtagcgtagaaaataactgcttcacgctgactgtggtccctctggagagggggtagggggtattctgggatgattttcccatcgtgatcaaacaccagtcgagtcccaaccttcgccgatacgtggcaggtagaaatggtgacatcattaagccttcgaagttttcttcttctaccccacatccattgcctgaaacttcaatgagatccattccatagtccttaagctttagattaactcttaggtgacaaagccaggattgaagctcatgcggtctggctccagaacaactcttcttcatagttacgttatactgcccctgcattgttggtattgaaaacggagtcttgctctgtcgccaggctggagtgcagtgacacgatctcagctcactgcaacctccacctcccaggttcaagcgattctcctgcctcagcctcccaagtagctggaactacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367697 - DNA, 1195 bp, Homo sapiens
cgcatgttcccagtcctaatatacattatgtgataagacacaagtaaatcatcctgaagttaagtctttaatgagaaatgcaaataaagcatttctcaataaattatgggaagagaatcaactgaagaataaacatctttagtaaatctttggctcgtgtgcattaaccaatactcttgaaaaccaggattaatttactgtaccttcttaatattcctttgaaattccttatggcgcacaggtagcgtagaaaataactgcttcacgctgactgtggtccctctggagagggggtagggggtattctgggatgattttcccatcgtgatcaaacaccagtcgagtcccaaccttcgccgatacgtggcaggtagaaatggtgacatcattaagccttcgaagttttcttcttctaccccacatccattgcctgaaacttcaatgagatccattccatagtccttaagctttagattaactcttaggtgacaaagccaggattgaagctcatgcggtctggctccagaacaactcttcttcatagttacgttatactgcccctgcattgttggtattgaaaacggagtcttgctctgtcgccaggctggagtgcagtgacacgatctcagctcactgcaacctccacctcccaggttcaagcgattctcctgcctcagcctcccaagtagctggaactacaggcacgcaccacaacacccagctaatttttgtattttcagtagagacagggtttcaccatgttggccaggatggtcttgatctcttgacctcgtgatctgcccgcctcggcctcccaaagttctgggattacagacgtgagccaccatgcccggcatatatgaagttttaaaaaatcagaatacagaacaaaatttattgggagatgagcttctttctttctctcttcaacaccatcgccacatcacctccacatatacacacactgaaaagatactgaaaagacataataaccatgggaaatggagattactggattgttaaatgttctttttgcctgtctttattctctaactttgctataatgaacagaaattattttttgataagcaaaaaatattttaaatttaaacatgtaaagtaacttagtagttgtcttttcaaaatatgtaagaatcattagttcactagttggttaaatatgtttttaatccca

SEQ ID NO: 367698 - DNA, 740 bp, Homo sapiens
aaagtatggtaaattccttcaaccaaacatcaacactattcaaccaataaaaatgacactatagttaatatatttgaaaagatgttcataatatatgaagtttttgttttgttttgttttcttagacggagtcttgctctgtcgccaggctggagtgcagtgacacgatctcagctcactgcaacctccacctcccaggttcaagcgattctcctgcctcagcctcccaagtagctggaactacaggcacgcaccacaacacccagctaatttttgtattttcagtagagacagggtttcaccatgttggccaggatggtcttgatctcttgacctcgtgatctgcccgcctcggcctcccaaagttctgggattacagacgtgagccaccatgcccggcatatatgaagttttaaaaaatcagaatacagaacaaaatttattgggagatgagcttctttctttctctcttcaacaccatcgccacatcacctccacatatacacacactgaaaagatactgaaaagacataataaccatgggaaatggagattactggattgttaaatgttctttttgcctgtctttattctctaactttgctataatgaacagaaattattttttgataagcaaaaaatattttaaatttaaacatgtaaagtaacttagtagttgtcttttcaaaatatgtaagaatcattagttcactagttggttaaatatgtttttaatccca

SEQ ID NO: 367699 - DNA, 407 bp, Homo sapiens
ccgggttcaagcaattctccacctcagcctcctgagcagctgggattacaggggagaaagggacatgctgctgctgatatacaacaggcagaaacaaatgatgccagatgtcctgtatcttgcacggttgttccacatgacagaactatctggctggcaattctactagactttgctagtctgtttatgctttcctactctccaaagaatgagactacatacactaaaaaaccaaaaagcctaaaaaaagagatgatattttaatttcaaaagcttaataatttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367700 - DNA, 626 bp, Homo sapiens
cgcatgttcccagtcctaatatacattatgtgataagacacaagtaaatcatcctgaagttaagtctttaatgagaaatgcaaataaagcatttctcaataaattatgggaagagaatcaactgaagaataaacatctttagtaaatctttggctcgtgtgcattaaccaatactcttgaaaaccaggattaatttactgtaccttcttaatattcctttgaaattccttatggcgcacaggtagcgtagaaaataactgcttcacgctgactgtggtccctctggagagggggtagggggtattctgggatgattttcccatcgtgatcaaacaccagtcgagtcccaaccttcgccgatacgtggcaggtagaaatggtgacatcattaagccttcgaagttttcttcttctaccccacatccattgcctgaaacttcaatgagatccattccatagtccttaagctttagattaactcttaggtgacaaagccaggattgaagctcatgcggtctggctccagaacaactcttcttcatagttacgttatactgcccctgcattgttggtattgaaagtaagtgtaggccctgggccttctatacctgggattaagtcacata

SEQ ID NO: 367701 - DNA, 418 bp, Homo sapiens
tctctggtaaaagtcagctctctaactactgcatctcacagctgaacaggtaaacatgttcactggacctgctttaaatacatatcccttaatgctgcccatagccagactatgtttccttagtccattcactcttccactacctcttgccttttcttttctcaagccttcaatacctcctccctcatcctcattctcagcagatgatcttgtttcctatttcactgtaaaaggagaagccatgggctgggcgcggtggctcattcctgaaatcccagcactttgggaggctgaggcgggtggatcacctgaggccgggagttcaagaccagcctgaccaacatgaagaaaccccatcgctactaaaaatacaaaattagccgggtgtggtggcacatgcctgtaatcccagctactc

SEQ ID NO: 367702 - DNA, 842 bp, Homo sapiens
aagtccaagcagaagtctgctgtggaggtggagccctcatggagaacctctactaaggcagtacagaggagaaatgtgaggttggagcccccacacagagtccccaccggggcactgggtagtggagctgtaagaagagggccaccattctctagaccccagaatggtagatccaccaacagcttgcaccgtgcacttggaaaagccccaggcactcaacgccagcccatgaaaacagccacaggggctgtaccctgcagaaccacaggggtggagctgcccagaactttgggagtccaccccttgcatcagtgtagcttggatgtgagacatggagtcaaaggagattattttggagctttaacatttaatgactgctccactgggtttcagatttgcatgggccttgcagcctctttgttttggcaaatttttcccatttggaaggggagcatttacccaatgcctgtacccccattgtatcttggaagtaactaacttgttttttattttataggctcatagatggaaggcttgtctcagataagactttggacttggacttttgggttaatgctggaatgagttaagactttggggttctgttgggaaggcatgattgtgttttgaaatgtgagaaggacaagagatctgggaggggccagggttggaatgatatggcttggctctgtgtccccacccgaatctcatctcaaattgtaatcctcacatgtggaggaaggtacctggtgggagctgattggatcatgggggtggttcccccaagctgttctcatgatagtaagttcattctcatgagatctgatggtttaaaagtgtgg

SEQ ID NO: 367703 - DNA, 228 bp, Homo sapiens
taaaaactttcttaaacctactgcaaaatctttttcctttaacgcacccctaaattgatctcactgagtttaccaatatctaattgacaaaaccatcagatatttttctgtccttatatttaactgtattcggtttcagaagttctcatcatgatactttaaggatgaggacagctgatgtggctggcctgaaaaataaggtaagaaccagaactaatctgcacagtc

SEQ ID NO: 367704 - DNA, 275 bp, Homo sapiens
taacagtgtttgcaagctataaaatagtgctttcacttagaaaaggctagacgtggtggttcatgcctgtaatcccagcactttgagaggccgaggtgagtgaatcacttgagatcaggagtctgagaccagcctggccaacatggcaaaaccctgcctctactaaaaatataaaaattagccaggcatgctggcacatgcctgtaatcccagctacttgggaggctgaggcaggagaattgcttgaacctaggaggcggaggttgcagtgagcc

SEQ ID NO: 367705 - DNA, 233 bp, Homo sapiens
ttactttagtaagtaatgcttcatttgcagcttcaattacttcattcctatcttggacttgttgatgcaaattgcttacagtatcctgagcttcttctaattccaattttgccttctctaactgttcgtttagttgctgaacagaagacttttgagagtcagcagaaatcttccactttgcatggttctcttgatgtgaaatcatctatatagccccagaattggaaaagaaa

SEQ ID NO: 367706 - DNA, 1069 bp, Homo sapiens
cttgcagttacgggtccgaaatcccggggtggactactactactaaaatgtcggcggcgtggaccccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatgtaagccttcatttttagacatctaagccc

SEQ ID NO: 367707 - DNA, 1411 bp, Homo sapiens
  misc_feature (1373)..(1374): n is a, c, g, or t
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccaggcaagcgcgcgcctcactgtaccggagagctccaagcacgcgcttggtctggggcccggacgctacatctgggaaggggtgggtggctgggtagataggcgaggaaggatcgtctctaccctctctcaagtagctgaggcctccgaaaccttccctagctggatttggggacagaggagcgctggtattgataaaataactctctttgctattcctttaggagcccaaatgaggattgaaagtgagaagaatgggacctgggcttgggggtgggaggtggggaaagcagaaccccgtgtgcctgtttctgcgtcgtctggagaaaaagcttttcaagatgtctgatnnaccttattcggttcaaagctctctaaagtccttcacc

SEQ ID NO: 367708 - DNA, 2926 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatgtaagccttcatttttagacatctaagccc

SEQ ID NO: 367709 - DNA, 2977 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagctgaggcctccgaaaccttccctagctggatttggggacagaggagcgctgttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatgtaagccttcatttttagacatctaagccc

SEQ ID NO: 367710 - DNA, 1979 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagctcatagatggaaggcttgtctcagataagactttggacttggacttttgggttaatgctggaatgagttaagactttggggttctgttgggaaggcatgattgtgttttgaaatgtgagaaggacaagagatctgggaggggccagggttggaatgatatggcttggctctgtgtccccacccgaatctcatctcaaattgtaatcctcacatgtggaggaaggtacctggtgggagctgattggatcatgggggtggttcccccaagctgttctcatgatagtaagttcattctcatgagatctgatggtttaaaagtgtggcatttacacactctttctctcctgctgccatgtaagacatgccttgctttcccttaaccttctgccatgattgtaagtttcccgaggtgtccccagccatgtgaaactgtgagttaattaaagctcttttctttataaatta

SEQ ID NO: 367711 - DNA, 2082 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagtagagatgcggtttcgccatgttggccgggctggtcttgaagtcctgacctcaggtgattcacctacctcagcttcccgacgtactgggtttacaggcatgagccaccgttcccggccaaggagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367712 - DNA, 2166 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagtagagatgcggtttcgccatgttggccgggctggtcttgaagtcctgacctcaggctggagtgcaatggcacgatctcggctcactgcaacctctgcctcccgagttcagtagagatggggttctgccatgttgatcttgctggtctcgaactcttggcctcaagtgatctgcccacctcggcctcccaaatgctgggattacaggagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367713 - DNA, 2285 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagaaactcactctgtcactcaggctggagtgcaatggcacgatctcggctcactgcaacctctgcctcccgagttcaggagggctctgagagatttcatttctgtcctgctgatgaagtctacgttcattcagggcctgctgtggaagaccagccccaaaggcggagtctcactctgtcgcccaggctggagtgcaagggcacgattgcagctcactgcaacctccacctcttgggttcaagcaattcttgtgtctcagcctcctcagtagctggggttacaggcatgtgccacaatgcctggctaagttttgtatttttagtagagacgaggtttggccatgttggccaggctcgtctcgaactcctgacctcaggtgatccgcctgcctcagcctcccaaagtgctggaattatgggcacgagccacggcatctggccaaacagcaatttaaaaaactaacgaaaaatctattcatgattttaaaaatttctatttcatacaaataaaacaatcttgggctaataatatata

SEQ ID NO: 367714 - DNA, 2388 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatgaatttcctttcatctctggtaaaagtcagctctctaactactgcatctcacagctgaacagataactgataccgtggttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaagttctcatcatgatactttaaggatgaggacagctgatgtggctggcctgaaaaataagaaactcactctgtcactcaggctggagtgcaatggcacgatctcggctcactgcaacctctgcctcccgagttcagtagagatggggttctgccatgttgatcttgctggtctcgaactcttggcctcaagtgatctgcccacctcggcctcccaaatgctgggattacaggtgtgagccaccgcgcccggccaagtaacaatatttctggatataatacctgaaaactcagcgcagaaagatataaagggataaaaaatttataatatagtcattacaatggaataaaatgaaatataaagcaataaaaaggaacggacagctgatatatgtaacaatatggatgaatctcaaaagcaatatcaaaagatcaaaagggtatatattacatgattccattctggaaaaggcaaaactatagggacagaaaacaagtcaatgataggcagtgggccggggggggaagtgatttattataaagaggcatgaggaaactttaggatgacataaatgttctatgtctttatatggtggtgggtacatgactgtatacttttgacagaggtatatctaaaaggggtgagttttactgtgtataaattatacctcaatgaacctgactaaaaaaaaaaaga

SEQ ID NO: 367715 - DNA, 1498 bp, Homo sapiens
cagctctcgagcatcgttgccacccgacattagaagatcttcttgatcatttattgatagcagctctgggatatgagatcatcatcttccagacgaggaagccatagtaccttcctgtttctcgcgccccggcttttaaaaactccccagctctggtccactactccaccgagatttctcaaaagtcgccctcggagagtgatcccggggggtgctttgcgaagagggtgcagaaaatgaacggaggagcagctggcttgagggctgggaacactcgcgtgtgtgagagatttaggatgagtttgggaagaaagtgggggcccgaggattctagagagagcacagcccaggctgaggaggggaaagcgcggtggtccggaaatttgagcggctggggaaccaccttcgtgtctcctcagaggggcgggcgctgtcgcctaactggtccccaacggcgtcggagcagaggcaagatccaggggcactggcctcgccgcggtaccgggcgggtacccagcgggctcggctctatagagcccgaggccccgctgccgctgccgccgccgccagcagccgttgccgccgcctcggccaaaccatccttcagacacccgcgccgccgcctcacaacatgtccgccgctgccgctgccgctgccgctgctggaacggcgacggccgcctgggaactaatatggacagagccaggcacagtgggagtcgcagtggctgccgccgcggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggaccagttggctgtcatcagctctagaaagggtgtggctgttttacattggctgttttcctcacattcctcaagcaggagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaataaaaaaatggaaggaactgg

SEQ ID NO: 367716 - DNA, 1413 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctac

SEQ ID NO: 367717 - DNA, 296 bp, Homo sapiens
tactactactactaaattcgcggccgcgtcgacgaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagaaagttttgccctatagtgagtcgtatgtcgacgcggccgcgat

SEQ ID NO: 367718 - DNA, 334 bp, Homo sapiens
gctacatgcccattttaataactttgaatttgtttttccaaagaaacatagatatcaagatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagaaattttaatacgtgatgactacatggaaaggtaaaacacctttggaataaaacctaaagctattaaacgattccattgtaaataata

SEQ ID NO: 367719 - DNA, 278 bp, Homo sapiens
gaattttttttttaacttagcattaacttttaaaatctggcaaatctgcctgtgaaattctaaacataatagtaaacagctgaagatctctctatttataaaagtttggtatatgtaatacatatgaaaattttttgaatcacagagagttgctttttggtactaagggtgatactaacggtgtatttggttctctaggtaagtgctttactaagtgtttgtagaaaggaaaaatgcaacttacaagtgatttttttttccttcctgtttgttcttgt

SEQ ID NO: 367720 - DNA, 5087 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaggctgc

SEQ ID NO: 367721 - DNA, 4706 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaggctgc

SEQ ID NO: 367722 - DNA, 4835 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaggctgc

SEQ ID NO: 367723 - DNA, 4035 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacactacccaatttcattatcctcccttcctctttccatctctattatctctcacatcggggtaccgagctgatgt

SEQ ID NO: 367724 - DNA, 378 bp, Homo sapiens
gcgacgcgaacagcttctgctagatgagctggtggccctggtgaacaagcgcgatgcgctcgtcagggacctggacgcgcaggagaagcagtgagtgggcagtggggtcgggtcgaggctgggccacctgccgaggggccgagaagtgtgcggaaagttcaatccagaggtcgcgggagggccggggcagcctcccactggcctggtgctccccattcccgctggggatccaaatactgggcgacgggggagtgctgctctgccctccacgaagaaaaataattttgtttcctgtttgtcctgtttgtctgacatccagggccgaagaagaagatgagcatttggagcgaactctggagcaaaacaaaggcaagatgg

SEQ ID NO: 367725 - DNA, 393 bp, Homo sapiens
cctgtttgttcttgttaacagaaagggttcaaagacaccagtcagtatgtagtaggagaattggcagcactagagaatgagcaaaagcaaattgacacccgtgccgcgctggtggagaagcgccttcgctatctcatggacacaggtacggtgcccaattacactgtaaacagttttggcaaattgagcgttcacaaactcttatagagttttggaagtgtgaatctttgaagcctgaatgttcagcaaaactgccttgaaaataaaaaggctgcgatttgcagccacctctctgggccctggtgataagagtgccttcatgggaagtgataactcgccctgataccgtgtgagccagcactattgaacagtgtgctcatccatgcagagttg

SEQ ID NO: 367726 - DNA, 402 bp, Homo sapiens
tagtaaatgcacgcgtccaatgctcgtccagatcagcggtcacggatacgactcctagccagagatgagtcagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaaaaaattaaaattagccagacatggtggtgtgcacctgtagtctcagctactcaggaggctgaggcaggaggattgcttgacc

SEQ ID NO: 367727 - DNA, 5012 bp, Homo sapiens
gggttgcttgctaggacacaaggttagcatgcccctgtagcagcaatgtgagaatcagaaaaggtgactgtgcatctcaagaagccgaatcaaaaagccaagccaaccacctaaccagtgattttcaagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaggctgc

SEQ ID NO: 367728 - DNA, 4781 bp, Homo sapiens
tactactactactaaattcgcggccgcgtcgacgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaggctgc

SEQ ID NO: 367729 - DNA, 4310 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatgacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaggctgc

SEQ ID NO: 367730 - DNA, 3628 bp, Homo sapiens
gagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaatgtatattaattttttgtgtggtttcatgattgctgataattccaaactaaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctgtaagtacatgatcattatgct

SEQ ID NO: 367731 - DNA, 1613 bp, Homo sapiens
agtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccgacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtctttttttttttatctctcttgatgtcagattttatagtctttttaaataaatccatttaattaaaacgttaaacttacctttgtaag

SEQ ID NO: 367732 - DNA, 1609 bp, Homo sapiens
agtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccgacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaattttaattacaatatggttgttggggtggaatggttttacattgtgcatcttttattgtcattaaactatgggttttaaatcctgggagatatagggttagaaactttttaaaaaaagggggggatactggggcgtggtcatttaaggcgtcaggataaaaggggaaaaggaaagttgaatggtt

SEQ ID NO: 367733 - DNA, 574 bp, Homo sapiens
tggccgcgtttacttacgtcgtgatggggataacctggcggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtctttttttttttatctctcttgatgtcagattttatagtctttttaaataaatccatttaattaaaacgttaaacttacctttgtaag

SEQ ID NO: 367734 - DNA, 1822 bp, Homo sapiens
agtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccgacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtctttttttttttatctctcttgatgtcagattttatagtctttttaaataaatccatttaaatctaagtgaaaactaaaataccagaaaagcaaaaatagataagatgtaaagaaataaggaacgaatataatataaatcagggtagcattaaaaatggagaggggaagagtttctgaaacaatggggggactataagccacattctacagtttatttaagaaaagcttctataagatgtgaaatttatctgatgcgcgaagagttatgtaatgtatggagaagatctaaatataaa

SEQ ID NO: 367735 - DNA, 1559 bp, Homo sapiens
agtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccgacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacattacattgtagccaatcattttatatttgtcaatttaaatcttatgggtctttttttttttatctctcttgatgtcagattttatagtctttttaaataaatccatttaattaaaacgttaaacttacctttgtaag

SEQ ID NO: 367736 - DNA, 451 bp, Homo sapiens
ttagaaatgagttggcatattgcttataccattacataaaatagctaaagcattttgaatttcagagctgtacccacatcagcctcagtggtttcaaatttattttaaagacagatttagatttgggcaattctgtcagtcttttcaggtgatacaccactgtaaaatattctgcttatcactgggtgtggtggttcacgcctgtaatcccagcgctttgggaggccgaggcaggtggatcacttgaggtgaggagttcgagaccagcctggccaacatggcaaaaccctgtctctactaaaaaatacaaaaaattagctggatgtggtggtgcacccctgtactctcagctacttaggcaggagaggcaggagaattgcttgaacctgggaggtggagtgagtcagctcacttccctccagcctggattacagagcgagactccgtctca

SEQ ID NO: 367737 - DNA, 545 bp, Homo sapiens
ttgatcaaaattaagtcacagattgccagatacaaactgaccacaagcacgtacttcctataccatatgtacgtctaagtccctttctaagaatacattccaatttagtatgaatagaaattacatttatagtctttagaaatataatcagttaataacttgattatattttctgcatatattatatatatttgattatatattgatattgattatattttacacaataattattttactgtattctgtgtttattttggggaaaagcctttttttttcagttggaatcacttttaatatttaaatacaaaaaatgagcactggcttctctttttttaaacacacacacaaatctaacagccaaaatgtgcagaggaaatgagctcctgctctgtcttccccagtccccatcctgtggctgaagctgcagccagcctctttcctcttatacatagggattcatagtggccacattacaccacagttgtaatgcattttgtctgttttacattgtgtgcatgtccctccccaacagctccattctt

SEQ ID NO: 367738 - DNA, 328 bp, Homo sapiens
ctcacagttctagaggctggaaagtgcaagaccaaagtactaggagatttggtttctggtgagggctcacactctgattcatagagggccccttcttgctgcattctcacatggtagaagggacaaggcagctttataagggcatcatctcattcataagggttctaccttcatgacctaatcacctcctaaaggtcccacctcttacatcatcatcttggtggttaggattttaacatatgaactttgagaggacacaaatattcagaccatagcaattgttctaagacgtaaaggcaaaaaaattgacagactagataaaacaaaa

SEQ ID NO: 367739 - DNA, 414 bp, Homo sapiens
ttatgatacagtaaaattttaagtgagtttttatagggttagttcttaaacctataatgtttttaatcaacagagctgacctagatttcagtaggataatgttgctgaattcattacatttgctaatcctggctgtactaagcacacaggtgaagtaaagttcagcaagctttgtgttttcgctgttagtgaactgctcttagcacaaattaaatttaatattgacaaatgctatgccatctgcagaaaggcggaagaacagcttgggctctgacttctgtggttcaacgacaaaaggaaggctaaaatgagacaggttataacctgctttaaacttgacagctttctaaagctgctgggaatccaactggtggttattgaaggtctataaaaattaagtatacatttatcttg

SEQ ID NO: 367740 - DNA, 369 bp, Homo sapiens
ggtgaggggaacagggggcaggccttcagggcagctggtagggggtgggagcaggccagcacagagccgcttcaccaggcggcggttggagccagacagggctgaaaaggagaggttactgcagatcgcatccaaaaactcatcaggaaactggtcgtggcaggcctgtagccagccttgggcacctggtgcccaggacactgcataccacacagctgtctggcagatggcagtggtgctgggatggggctgtggagtggcaggcttggtgtgctggcagagcaagtggatggagaagttggaaatgctgtagggtggtgctgggcctaagtggttctcacagagggcctccacagtgatggctcgccg

SEQ ID NO: 367741 - DNA, 692 bp, Homo sapiens
cgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgccccgccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctatgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 367742 - DNA, 502 bp, Homo sapiens
cgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgccccgccgcgccctctgcccacccgcccgcgcacccaccgccctcggcagccgccccaggatggggccctgcgcctatgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 367743 - DNA, 1167 bp, Homo sapiens
cgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgccccgccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctatgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccacagcctgttgtgtgcctctctcgatggcctgtcttcagggagctccctggctgatgaggtggggtcaggatggatgtctcactacagtgtgcaatccatccccttaatcagggccctgggtggggaggaggagccctgttgcaatctgcactgtgggtagcacaggacagattccttgggcagtccagagtgaggtggagaggcattagtcggtgatcccaagggcatctgactctgagggtggaatcccaggatgaacccatggtctcccccttatcagggatacctgccacctctacccttcttgtctctacctctgcatcccattctctgcacccacagcttaggtgcccctggcggcctcaaatcctgtctgaccttgcccctcttgctgatgcaacttctcagcaattccagattctgcagaggagtcctgctgggttgttgtctgtttgcacctgatcacacaaggcagag

SEQ ID NO: 367744 - DNA, 637 bp, Homo sapiens
cgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgccccgccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctatgagatcaggcagttcctggactgttccaccactcagagtgacctgtccctgtgtgagggcttcagcgaggccctgaagcagtgcaagtactaccatgccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 367745 - DNA, 400 bp, Homo sapiens
ccctgcgcctatgagatcaggcagttcctggactgttccaccactcagagtgacctgtccctgtgtgagggcttcagcgaggccctgaagcagtgcaagtactaccatgtgagtgagtggaccccgactcaggccgggagggggagaggccaaccctcctcttgcacctgcaggctgaccaccagcctgtgctgcccctcccttcccaggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagacca

SEQ ID NO: 367746 - DNA, 472 bp, Homo sapiens
cgccggctgtgacaagcgctgcggcatttgtccccgcgacagcaccgctgccgccgtctctaaggtcgcccgggtcccaccgccgccaccatgcctcggggaagccgcagcgcggcctcccggccagccaggcccccacccccgctgccccccagcccctgcagatggggccctgcgcctatgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 367747 - DNA, 928 bp, Homo sapiens
agtagtttgctctcctgcgttttctattcttgtctgtgggtttttctcccttattgttgtcccccccctcccgctggtgggtgtgtcttcttcctccaacatgatccgcctcgtttcgctcgtggttcttcctccctcctcggcgtctggtttttcgaccctgccgccgcctcgtctcctgcttctttttattactcgtgcgctctcctcttccgggggcggcccctctctttgtctcacaaagtatgtggtgtggctgtcgcttttctgtggggccggctcccgcgcgggggatttttttgttggggcgcgccgcccgccctctcttctttttttttttgtttgtttctgtttgttgtttttttttgttttgtttttgtgtgtttttgtttgtttttttgttttttttttttgtttttttcttttgcaattaaaagtttattttagaccacagcctgttgtgtgcctctctcgatggcctgtcttcagggagctccctggctgatgaggtggggtcaggatggatgtctcactacagtgtgcaatccatccccttaatcagggccctgggtggggaggaggagccctgttgcaatctgcactgtgggtagcacaggacagattccttgggcagtccagagtgaggtggagaggcattagtcggtgatcccaagggcatctgactctgagggtggaatcccaggatgaacccatggtctcccccttatcagggatacctgccacctctacccttcttgtctctacctctgcatcccattctctgcacccacagcttaggtgcccctggcggcctcaaatcctgtctgaccttgcccctcttgctgatgcaacttctcagcaattccagattctgcagaggagtcctgctgggttgttgtctgtttgcacctgatcacacaaggcagag

SEQ ID NO: 367748 - DNA, 660 bp, Homo sapiens
cgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgccccgccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggatggggccctgcgcctatgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 367749 - DNA, 296 bp, Homo sapiens
tccctgtgaactgttttaagttcaaatgtatgtgtgggtgaaaattttcagcacacagatcaagaagctcaccattaatataaccttattcatcacactgaattttttggaaacaaaaaattgaaaatgtatgctcttaattagccaggtgtggtggcatgtgcctgtgcctatagtcccagctactcagaaggctgagatgggagggttgcttgtgccagggaggtgggggttgcagtgagccaagattacgccactgtactccagcctgggcgacagagcgagaccctatctca

SEQ ID NO: 367750 - DNA, 362 bp, Homo sapiens
gcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaaaattccttttgatgtagaaactcagagttgacaggaccttaaaagtcaccccacccagctgccactctcttgattgtcctctgcagcatcacttccaagtaatgacctgtctgctgtgtgagcacctctcatcacaggatactcactaccctgcacccaggcaggcaggatgtcctgtcactgcagatttcaactattaaaaagt

SEQ ID NO: 367751 - DNA, 681 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagaattccttttgatgtagaaactcagagttgacaggaccttaaaagtcaccccacccagctgccactctcttgattgtcctctgcagcatcacttccaagtaatgacctgtctgctgtgtgagcacctctcatcacaggatactcactaccctgcacccaggcaggcaggatgtcctgtcactgcagatttcaactattaaaaagt

SEQ ID NO: 367752 - DNA, 855 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagggtattcccgtcctctcctgggtctttgggctaaggtctaaggactgctgggaagaccaccttagaagatgtatgtagttacctggatactacctgctcgtaattgaaggattatctacaatgtcttctgtacaacgtgggcttactaaggttctatgactttgccactctcagaattccttttgatgtagaaactcagagttgacaggaccttaaaagtcaccccacccagctgccactctcttgattgtcctctgcagcatcacttccaagtaatgacctgtctgctgtgtgagcacctctcatcacaggatactcactaccctgcacccaggcaggcaggatgtcctgtcactgcagatttcaactattaaaaagt

SEQ ID NO: 367753 - DNA, 590 bp, Homo sapiens
gcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaagtaagctccccctgtcctgggtacgccgttgtttcctttgcagttatgaccatgtacagatagtgctctttgatttttcagaaataacaaaacttttaactcgtttacgacataaggtaactgaagagctctttcgttttgtttggtttttaagtttaaattctctaccaattggaatccagtaaaccagaatgattcattaacctgattgctttttttccctgtatttctcgtacatgagaaaaagattttttaaaaaaacaaaaaagatatccgggatccctttttaaaaaaattattttaaaaaacaacaacaaagcttctccaaatactgtgctttgtagacacttcgttcaggccccgctgtcttttaacccagaactgaacagtaagagtgaatgcaggaagaaagttgacggtgaatctggagtcc

SEQ ID NO: 367754 - DNA, 4310 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgaactctggtaggaaatgaggaggacacgtgattcacacaaacttctgaaatgcaagcacctttttcttattcacaggtaatatgcattaataagta

SEQ ID NO: 367755 - DNA, 3925 bp, Homo sapiens
gcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaattccctgtgtctctggtggtttgcctaaacctgcaaacatcaccttcttatccatcaacatgaagaatgtcctacaatggactccaccagagggtcttcaaggagttaaagttacttacactgtgcagtatttcatctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgaactctggtaggaaatgaggaggacacgtgattcacacaaacttctgaaatgcaagcacctttttcttattcacaggtaatatgcattaataagta

SEQ ID NO: 367756 - DNA, 2647 bp, Homo sapiens
acgaggcagggcctgcctggttcctggaagtcttcccagtcttcccagccagcccgggccctggggagccctgggcacagcagcggccgagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgaactctggtaggaaatgaggaggacacgtgattcacacaaacttctgaaatgcaagcacctttttcttattcacaggtaatatgcattaataagta

SEQ ID NO: 367757 - DNA, 1406 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacggtaagcctgaaatggaatggggcatacattcatgtaccactctgtagctaatgtgggaacaaacaaccctgatgcattgattctctgcatgtgaatctgggaagtcatgatgttcaaaagatacgccgcacaaaataaagttctatatacagaaattttacagaactaacttcagatcttctttacagaaactctgttgacaggatatggtgttgttattggagtgtagagagattgtacacttcactttgatgaagagctttcacttgcacagtctttctctgagaagaagaaaaaaatgtgagcaaggacccaggacaatgaataagaactctatccatgtgttgtttagaattgttctcagcattggtccagttcctgaccatgctctgctgagctaaaggaaaagagtatattgaaactgtgctgaaaaaaaaaa

SEQ ID NO: 367758 - DNA, 529 bp, Homo sapiens
ctctgccacacccagtctttgctactcttcatgtggctgagattctgactttacagaatgtaaaaaaggtcaagaaatgaagcaactcctctgccagttagaagagggggcaccaacgccccagccccagccctggactggagaaatacccacccagcgaatcacttctcgcttccaactatcttttgtgtgtcttgggtctcttgcctcccagtgagtgaggttttctgtatattgcaagcataactttcatttacatgagttggtaagagtaggtctttaaaactgtctggtgacaagatattctacctaacagctgtttttaatgtctctctaaagtgaaaaggtgaaaatcattctcttttctctttatagattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagcctta

SEQ ID NO: 367759 - DNA, 4489 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgaactctggtaggaaatgaggaggacacgtgattcacacaaacttctgaaatgcaagcacctttttcttattcacaggtaatatgcattaataagta

SEQ ID NO: 367760 - DNA, 4244 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgaactctggtaggaaatgaggaggacacgtgattcacacaaacttctgaaatgcaagcacctttttcttattcacaggtaatatgcattaataagta

SEQ ID NO: 367761 - DNA, 2301 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagataaatccatactactgcctacaggcaaaactagaccgaagccattccaaggaactgacagctcagaactataggaaaaaacttgaggggggccccggagccaagtcagccccataatagtcgctttacagtgcatgaccccaattcaaacaacgtcgacactg

SEQ ID NO: 367762 - DNA, 1886 bp, Homo sapiens
cgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcggggaaacccttgaaggcccccttcaagggaaggaaggaaggagggttggaaacaatttaaggggtaattggctttcggcaatttggaattggcgcaaatttttttggtgacttcttgaaagaaaaaacaccgggaaatggttcacttctcttttctaacccaaggcaaaggaagttcccttcaaagcaagaaacaaaattaacccccgggattaaaacagttcctttgaacttattgcattacttgatgggttcaggaaaccaactttgaaccatttctggttggcgggggccctttgaagaaaggcagggaagtctccaacttcggcacgggaaggacggttgttccacacacaaaggggaactcatttctattgtgcacgtttcgcaagggcaagaggtgggcgcaggtcctgtggggcccccgcgcaaagcgtttaccagtactccaataaacccctta

SEQ ID NO: 367763 - DNA, 2632 bp, Homo sapiens
tcctttaatgacaactcccaaggaaactgggtgttgagagggaggagctctagcaataggcacattttggaggggaggggccggaggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatcagaggggtcctgtggcagtgctttcagttgtggggggtggaggtaggtttttgcttagcaggggccaggtatggtgcctggcaacgagcctgggcctttcaagcagaagagaacttgactccaagtagaggggtcctggggtgatctggctgataccattgtcagtccagaggtgtctgcccctttcctccagttgcccctccaggagctccactggggtggtcccaacagggctgatttaccagggtggcactgctggccctcacaacctgaacgtcaccagtggctgagttcccggagctttcatgatatttggtagggtcttcctggcccagaggacttccttcagtcccatctttgcagggcaggggtcaggtgtctccaagagccacctctccagtacccccttgtggtcatctgctactgttgcttaaccgaaccaagatgatccttgccatctgagacctctggtgcaggaagttggcc

SEQ ID NO: 367764 - DNA, 1996 bp, Homo sapiens
tcctttaatgacaactcccaaggaaactgggtgttgagagggaggagctctagcaataggcacattttggaggggaggggccggaggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgcccttctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatcagaggggtcctgtggcagtgctttcagttgtggggggtggaggtaggtttttgcttagcaggggccaggtatggtgcctggcaacgagcctgggcctttcaagcagaagagaacttgactccaagtagaggggtcctggggtgatctggctgataccattgtcagtccagaggtgtctgcccctttcctccagttgcccctccaggagctccactggggtggtcccaacagggctgatttaccagggtggcactgctggccctcacaacctgaacgtcaccagtggctgagttcccggagctttcatgatatttggtagggtcttcctggcccagaggacttccttcagtcccatctttgcagggcaggggtcaggtgtctccaagagccacctctccagtacccccttgtggtcatctgctactgttgcttaaccgaaccaagatgatccttgccatctgagacctctggtgcaggaagttggcc

SEQ ID NO: 367765 - DNA, 491 bp, Homo sapiens
aactcacatagttgagttccatgaggcctttcctcatttcccgcaccccagtattaataaagagctgtacctctttgtgacattgattacactgtcatttgtgttcctgtcttgcttctcaactaaagtgtgaaatcctacagctcacctgtgtccctccatgcccccagcacagaacctgacacagggcagactcgcaacaagtgtctgttaaaagaaacctccccaattacttagtcccaattaataatttggctcagtgagcaaatgtaagggtggaaatttaagggtgatttttctgttacacatacctgagtgtgagctggttaacagagattgctttccaggcactgggggtgtgaaagttttgatggagggagggatggggagaagacatccttttgctcagcatctggatagatgggggctgtacaggtgggcctgactgcaggggtttttgaaagtagatagatgatgccagatatcttgtg

SEQ ID NO: 367766 - DNA, 1190 bp, Homo sapiens
ggccaagccaaagggctctcacactaagtgaagcttctccattctgtaagctttccgggaacatccaaggcaagactggcacccagcacagcagtgactgaccacataccccactctccaggacccatggagtccttcagctcaaagagcctggcactgcaagcagagaagaagctactgagtaagatggcgggtcgctctgtggctcatctcttcatagatgagacaagcagtgaggtgctagatgagctctaccgtgtgtccaaggagtacacgcacagccggccccaggcccagcgcgtgatcaaggacctgatcaaagtggccatcaaggtggctgtgctgcaccgcaatggctcctttggccccagtgagctggccctggctacccgctttcgccagaagctgcggcagggtgccatgacggcacttagctttggtgaggtagacttcaccttcgaggctgctgttctggctggcctgctgaccgagtgccgggatgtgctgctagagttggtggaacaccacctcacgcccaagtcacatggccgcatccgccacgtgtttgatcacttctctgacccaggtctgctcacggccctctatgggcctgacttcactcagcaccttggcaagatctgtgacggactcaggaagctgctagacgaagggaagctctgagagccctgagcctagcacattccaccttgacaaaatggttgactgagaaaacacagataatgggcttcctaaccctgctcacctggcactaacacttttcaatcttcaggcttcattccttcccaagagtgcttttgactctgagaccagcccacccccaaacagctagtggagaaggagcaatgctgaggggtgaggcctctctcccactccagccccaggacaggaaacagaactgcctgaaaaaggtgaagtgaaacttggatctctatttctcccataagggacttctgaaacagggaagccccctcccatgtgaaccaaggaaaggaggcacagcccagagaacccctttggggatactaaagacagaagaggggaaggtggcccttagagacagagcttggacagatgccagaggctctgttccagagtgcaggaagaaggggctagggcaggggagattctcataggggaaataaaactactaaaatatgaaaagggctcaa

SEQ ID NO: 367767 - DNA, 359 bp, Homo sapiens
tgaaacataaatgaattttctgtttaggcttctgcctcatcctgaagatatctcattatgtacatgcagatattccaaaatctgaaaaaatccaaaattcaaaatgcttcttgtcccaagcatttcaaataatgatattcaacctgtatatacttaaaggaccacaggaaggcatcattaacaaaacaagttgagggccaggcgcagtggctcacacatcaaaacttcaggatgctaaggcgggagtaccacttgaggccaggagtttgagatcagcctgggtaacataaagagaccccatccctacaaaatgtacagaaattagcctggtatgatgacatgtgtctgtagtcctagct

SEQ ID NO: 367768 - DNA, 487 bp, Homo sapiens
cagggaaggatcttcgttgactcctccggcttcagggggctccaggcgtcccttggttctaaccgctgcctctgtggtcttgtggccgccttccctgggtcctcagatcccccccttgcatataaggacacttgtcgtgggatatggggcccaccctaaatccaggatggtctcattcgaagatccctaactgaatgaattctgtaaagaccccttttccaatcaaggccgcatttacagattcccgacacgtcactgggaagccaccatttggtcctcaacatcccgtctcctccgcccccagatgcgacggcgtctcagcagcgacttggagccatgcagggtttctgttgtggttgttcacttgggtaagcttcctgctcttaccgacagtggatgacacactccccactcccacgccacttcatgttccttcgggagcggagggggttggaagaataaacacccagatcttcaagacgtaaag

SEQ ID NO: 367769 - DNA, 680 bp, Homo sapiens
ggtagcttctgcagtatttatttctttaaatatttaacagtgttgagaggcaatgactcgcaataatatgtagagtttctagcacattatgagtgcttaataaatgttagaacaataaaatcctgtatgatgaaaaacagcagtcagtaaaactatacagtctacgatattttaaagccatagcaataactagtttaaaaagaatagaaagcaaacagtgcattgattaaatcacggtcataaaggaacatttacgttcactaaaaagtccacccaggtaatttccccttgtatgtattaggggatggaaagaaggcacaggaaaagtggataaagtatggattaaaaaacaactcttcccccatccccccgccaccccccaaaagccaggtggagctctattgaccacaagccggggtagctacatccagtgcaacggtggggtgctccaagcgccttcgaaacgtcctctacgccagcaccaactggcaaaaccttctaattttctagacgcctttctgcttggttttggaaggggaggcacccaagtgggtgtgtgcgacacctctagttgtaagccgggacacagtgacgtcgagagagcgctattctactcggagaggaagttaatcccatcgaactccagccaggaaaacgtgggcttgggaaccgcggccgct

SEQ ID NO: 367770 - DNA, 865 bp, Homo sapiens
attctcatatactgtactattctttagctgtagacaggatgaagtgtttagggcccaggtccccttaccatgtgattatatttcactcaagatctgagcagcaacctcagaacaagatataagtatttccattacatgattcagtatggtggttgatttttctgaagcaaaaggcagcaaatgtcccctttcctgttcagagatgacatgaaagacttgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaac

SEQ ID NO: 367771 - DNA, 623 bp, Homo sapiens
atgatgacttctgagcccacatgcagaggcagttgggggtgggaagcaggagaacagtgagagccaagatcgatggaccaaaaaataaagtctgccttggggaagtcctgactataggtagactgttttcatgaggtgttcttctcctagctcaagtaggggcccaggtcagggagctgcagcatcccagagctatgattgatgaacattgtacttttcccttctgtcttaacagttggggtgcaggattaggataggtagcctatgctgtctctaacagaaaacattacaggattgaacagaagagttccccttgcatacgtcatcttttggagctgctcttactcactgtcttgcgcctaaacagaggtccagattttggatgggaaaacaaagaggggttgagagcagcaagtgtttgatcaagtgaaaatctgctgtctgcctcatctcatgggtttctctgcaggattgagaccccttgccttggtgtacacaaattgcttgcatcagcttgagatcccaggacctttgccaggccacgggtaggcatctgtctggcttgggatgggagtttcttaggacacttattccctcatcttgctttcctaacccaggagttg

SEQ ID NO: 367772 - DNA, 3429 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggcttatcttgagtaataaaatagtacaggaagtgagagcgccacaaacaacagggggtttgctagttctttcgacgtctgtagaacacttgctacgtattctgtgctgacaatacgaacacattgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacaaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367773 - DNA, 3123 bp, Homo sapiens
attctcatatactgtactattctttagctgtagacaggatgaagtgtttagggcccaggtccccttaccatgtgattatatttcactcaagatctgagcagcaacctcagaacaagatataagtatttccattacatgattcagtatggtggttgatttttctgaagcaaaaggcagcaaatgtcccctttcctgttcagagatgacatgaaagacttgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacaaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367774 - DNA, 3560 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367775 - DNA, 1520 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcaggtgactacttttctaatgtgttttcagagctgtgtatttaagattgagtttggctctgggagatagaaaactcaaaacagcagagtgctgtggtgtgcatgtttgtgtttcccccaaaattctaatcaccaatgtgatgttacgaggtagggtctttgggaggtgatcaggtcatgagggcagtgccctcagggatgtgatgaatgcccttatgagagaccccagagagctgcttgccacttctaccgtgggaggacaccacgagaaggcgccgtctgtgaaccagaaagcagaccctcaccagacaccaaatttgttggtaccttggtcatagacttcccagcctccagaactgttaaaaataaatttatactgtttataatcta

SEQ ID NO: 367776 - DNA, 3854 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtagtaggagttaaaacccaaaaagaaaatgctgattaattatattcccaaaaatgaaaacactgagaaccatggaaaaactagtccttacttgtgtttgctctatgcagtaggagcatcaccatcacccaggagctcatgaaaaatgcataacttcaggcaccattccagaccttctgaatcagaatctacattttaacaagatccccaggtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367777 - DNA, 2395 bp, Homo sapiens
atgatgacttctgagcccacatgcagaggcagttgggggtgggaagcaggagaacagtgagagccaagatcgatggaccaaaaaataaagtctgccttggggaagtcctgactataggtagactgttttcatgaggtgttcttctcctagctcaagtaggggcccaggtcagggagctgcagcatcccagagctatgattgatgaacattgtacttttcccttctgtcttaacagttggggtgcaggattaggataggtagcctatgctgtctctaacagaaaacattacaggattgaacagaagagttccccttgcatacgtcatcttttggagctgctcttactcactgtcttgcgcctaaacagaggtccagattttggatgggaaaacaaagaggggttgagagcagcaagtgtttgatcaagtgaaaatctgctgtctgcctcatctcatgggtttctctgcaggattgagaccccttgccttggtgtacacaaattgcttgcatcagcttgagatcccaggacctttgccaggccacgggtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367778 - DNA, 2043 bp, Homo sapiens
aatgtggaatatgttgtatagtggtcacatggtactggtggtaatagtggcagaaatggcaaaagagccattggttgataaggttcaggagggcctaggctgttcctttgtaaactgtgctcagatatactctcttggctgtcctgggactcctacagggcttgaacattttgtatcaatttctgttttgaaggtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367779 - DNA, 1538 bp, Homo sapiens
cgcggccgcgcgactacggctgcgagagacgacagagggcagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367780 - DNA, 1536 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaac

SEQ ID NO: 367781 - DNA, 2064 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagatggaatttcactcttgttgcccaggctggagtgcaatgtcgcgatcttggctcactgcaacctccacctcccgggttcaagcgattctcctgccccagcctcccgagtagctgggattacaagcacctgccaccatgccagagtaatttttgtatttttagtagagatgggttttcgccatgttggccagactggtctcaaacccctgacctcagatgattcatccacctcggctcccaaagtgctgggattacaggcatgagccaccaggcctggcccattctgtcttcttttctttcaacattcatagccccatatctaggcccttaaacatctcttcccttggctattgctatagtatcctaagtggtttcccttcctcttacacttccccttctagtacatactctctccttactaggtaaaaaaaaaagtggttctcaaactttttagactaagaaatcctttacattcttaaaaaattatccaggacctcaaagagcctttgtttaaatgtggactatatccatcaatatttatcatattagaaattaaagcaggaaatttaaaaatattttaatagtagtaaatccattacgtgttaacatgttgtagactgaaatgtgtcccccaaaattcacatgttgaaactctaacctctaatgtaactgtattaggagctagggtttttaggagataatcaaggttaaatgaggggatcctaatctgatagtattgatggctttgtaagaagaagagagggattgctgtctctctgccatgcaaagacacagtgagaagactgctctctgaaggccaggaggagagccctcaccagagcccaaccattctagtaccttgatcttggacttccaaccttcagattgtgagaaaataaatttctgttgttaagccactcaaaaaaaaaa

SEQ ID NO: 367782 - DNA, 1370 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagggtctttgggaggtgatcaggtcatgagggcagtgccctcagggatgtgatgaatgcccttatgagagaccccagagagctgcttgccacttctaccgtgggaggacaccacgagaaggcgccgtctgtgaaccagaaagcagaccctcaccagacaccaaatttgttggtaccttggtcatagacttcccagcctccagaactgttaaaaataaatttatactgtttataatcta

SEQ ID NO: 367783 - DNA, 1341 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagctgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaac

SEQ ID NO: 367784 - DNA, 1453 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaac

SEQ ID NO: 367785 - DNA, 136 bp, Homo sapiens
aggcagcaaatgtcccctttcctgttcagagatgacatgaaagactgtgagttaatgttcggaaatattttggtttttttggaggataggtatcaagttcaaatataactagcactctaaaataagctaaactgaa

SEQ ID NO: 367786 - DNA, 3794 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacaaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367787 - DNA, 3506 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcagtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacaaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367788 - DNA, 2569 bp, Homo sapiens
gaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacaaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367789 - DNA, 3743 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttacaccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaatta

SEQ ID NO: 367790 - DNA, 785 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttagtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcaggtgactacttttctaatgtgttttcagagctgtgtatttaagattgagtttggctctgggagatagaaaactcaaaacagcagagtgctgtggtgtgcatgtttgtgtttcccccaaaattctaatcaccaatgtgatgttacgaggtagggtctttgggaggtgatcaggtcatgagggcagtgccctcagggatgtgatgaatgcccttatgagagaccccagagagctgcttgccacttctaccgtgggaggacaccacgagaaggcgccgtctgtgaaccagaaagcagaccctcaccagacaccaaatttgttggtaccttggtcatagacttcccagcctccagaactgttaaaaataaatttatactgtttataatcta

SEQ ID NO: 367791 - DNA, 2034 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgagg

SEQ ID NO: 367792 - DNA, 2115 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgaatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacaaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacataaatttttggtga

SEQ ID NO: 367793 - DNA, 1981 bp, Homo sapiens
aagaaagccgagtgatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttaggtgatttgaagtctaatatctttcccaatgagttacactcatttcccatccatctaatgggcgctggcagcgtgtttcgattattcttggcttctggcctccatccgaccaaatagctgttgctactcctacaagtttttctggtgcccgttatctccacgacagccgaatccaaagctttaagagctgctcggcagctggaacgatcggtggcttttccaaccccggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagatggaatttcactcttgttgcccaggctggagtgcaatgtcgcgatcttggctcactgcaacctccacctcccgggttcaagcgattctcctgccccagcctcccgagtagctgggattacaagcacctgccaccatgccagagtaatttttgtatttttagtagagatgggttttcgccatgttggccagactggtctcaaacccctgacctcagatgattcatccacctcggctcccaaagtgctgggattacaggcatgagccaccaggcctggcccattctgtcttcttttctttcaacattcatagccccatatctaggcccttaaacatctcttcccttggctattgctatagtatcctaagtggtttcccttcctcttacacttccccttctagtacatactctctccttactaggtaaaaaaaaaagtggttctcaaactttttagactaagaaatcctttacattcttaaaaaattatccaggacctcaaagagcctttgtttaaatgtggactatatccatcaatatttatcatattagaaattaaagcaggaaatttaaaaatattttaatagtagtaaatccattacgtgttaacatgttgtagactgaaatgtgtcccccaaaattcacatgttgaaactctaacctctaatgtaactgtattaggagctagggtttttaggagataatcaaggttaaatgaggggatcctaatctgatagtattgatggctttgtaagaagaagagagggattgctgtctctctgccatgcaaagacacagtgagaagactgctctctgaaggccaggaggagagccctcaccagagcccaaccattctagtaccttgatcttggacttccaaccttcagattgtgagaaaataaatttctgttgttaagccactcaaaaaaaaaa

SEQ ID NO: 367794 - DNA, 408 bp, Homo sapiens
cagaactacatctcccagcaggccccagggtagcctgcagcgtccctggctggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaatgtgaggcctgaca

SEQ ID NO: 367795 - DNA, 485 bp, Homo sapiens
tacgttgagtccatttttaatgttctgggtgccctgtcaggtgatcagaacattaaaaatggactcaacgtaaaataatcttctggacccttctaggacgacatggccgtgaccggtagtgctagaaaccagtcttcgagcccccagtgccacaccatgtccccccacctgcatacctgtggtctccccctgccaggcaccctgtgctgggcacagggacatccctgccaggcctagagggccttgtgtttttaaggcagtcaaatcttgcagcctggttcagtgccagctccaagggctattgggtagctgcaagggtcaattatgcattcctgtgagtcaggtttttccaacccaggcccttgactctgccctgagcttgcagctggatacaaagtgcaaaaaagcttggctccttctgtattctttaaaaacaaaacaacaacaaaaaaaaactgtaaaaacagcctccatgtccacgccct

SEQ ID NO: 367796 - DNA, 718 bp, Homo sapiens
gggacagtgggctcccaggggaatgcaggttgaccacatctggctcctgccaggcaacgagcagcatctggcagagtaaggggccaacgcccatgggggatggaccctctcagttcttgggaattctgccccaaaagtcctttccctggggtctcagagggcccccgtccttcccttcttggtgtcactgtggcccctcactgctcttttcctattcaaacctgagtcccaccaggcccagggcttcacctgctgagctgttgtgtccttgcctgtgacgaggcctggccaggggtgcaggagcagaaggtggggagggttatagacgctgcaaaggccaagagaacatctgagagtggcagctggtgacctggccagaggggctggtgaggggcagagaacctggctagaggctgggtccctcaggtggtcctctcaggtgggaggcgagcagcaggtgtgggtgaggggaaggttctgatgacagctgccccccccacccccaccccggctcctgcaggccgaccttattgctgtgctctgggcttgggggcggctgaggtgcccctctgtcctccagcagggcacgagtgacctgagaggcccactcaggcagaagagacgcaagctgggccgtccaactggtttcaactgccagctttaccaatgcagcatttattttaaaattaaattaaattaaaaaaaaaagattgcatca

SEQ ID NO: 367797 - DNA, 6116 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367798 - DNA, 5595 bp, Homo sapiens
atcatcagacacctgcaccagtctggcctgctgtttgcaccgaggacgctgtttctgatgttcttacttggaaaaaccctggtgtcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367799 - DNA, 5326 bp, Homo sapiens
gcccagggtcctctccaagcttctcttcttcctttaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367800 - DNA, 4852 bp, Homo sapiens
actcctggatctgagtctggtcgaacatggagaagacgctggagcttccgccctctactgtccttctcttggccctcttgggtgccatgtcttcagtctccggggggcaaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367801 - DNA, 6387 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaccgtaccgagcctgcgcaggcccgcctccccttacttggtgctggcggcctctagtgtgcactgagttattgcgggcactaatgtctccctccacacctgacactaacgacccgtctcccgagccccaccagccccaggtaagtggtgccctggccccctttgggtgcttacctggcatctccttcacaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367802 - DNA, 6267 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctgggtatgtggggagtcggggctggggcagccacgggtcaggaggggcccaggctcagtgctgcttctgtgcagggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367803 - DNA, 7062 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtggtgttgggacacctgggcgagatgtgagggtgggctcacttgagccactgaaaccagccaggtcttccctcaggccggacagatggcgcctgaccgaagttcctggcacctggaaaacccacaggtcagagtaaggggagaaaggaccctgccctccctgttccacgtctgtggggggagaggacaaatgccaggcacagggtaggcggcgagaacaaggcactcaatgtgtagctggggcagagactcggcctctggggagctgagcgggttccctccacccccaaccgtggtggaaagacaagctcgctggggcggggtgggggtctggtctccacctgcccctcccactcagccactgaggacaaggtggggcccaggcttctgggagggggagctggcacaaaaggaagtcctggggttgatgtgtttgagcgttaggcgaagtggttccccccatcccccaaacggaaaaatgtcagtatttgctaagctgtagagacctgatgccgtgatgtggcctgttccgcctccacccattacacggggataacgctggggggtggcgggcccacaaaagaggtgctggaggagactctcccacccctggccgggccggggctttggggccggaaggttcacagtacgcggtttgtccgaacgtcacggcttttattgggagttgggggtttggggtgccctgtcaggtgatcagaacattaaaaatggactcaacgtaaaataatcttctggacccttctaggacgacatggccgtgaccggtagtgctagaaaccagtcttcgagcccccagtgccacaccatgtccccccacctgcatacctgtggtctccccctgccaggcaccctgtgctgggcacagggacatccctgccaggcctagagggccttgtgtttttaaggcagtcaaatcttgcagcctggttcagtgccagctccaagggctattgggtagctgcaagggtcaattatgcattcctgtgagtcaggtttttccaacccaggcccttgactctgccctgagcttgcagctggatacaaagtgcaaaaaagcttggctccttctgtattctttaaaaacaaaacaacaacaaaaaaaaactgtaaaaacagcctccatgtccacgccct

SEQ ID NO: 367804 - DNA, 6763 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtggtgttgggacacctgggcgagatgtgagggtgggctcacttgagccactgaaaccagccaggtcttccctcaggccggacagatggcgcctgaccgaagttcctggcacctggaaaacccacaggtcagagtaaggggagaaaggaccctgccctccctgttccacgtctgtggggggagaggacaaatgccaggcacagggtaggcggcgagaacaaggcactcaatgtgtagctggggcagagactcggcctctggggagctgagcgggttccctccacccccaaccgtggtggaaagacaagctcgctggggcggggtgggggtctggtctccacctgcccctcccactcagccactgaggacaaggtggggcccaggcttctgggagggggagctggcacaaaaggaagtcctggggttgatgtgtttgagcgttaggcgaagtggttccccccatcccccaaacggaaaaatgtcagtatttgctaagctgtagagacctgatgccgtgatgtggcctgttccgcctccacccattacacggggataacgctggggggtggcgggcccacaaaagaggtgctggaggagactctcccacccctggccgggccggggctttggggccggaaggttcacagtacgcggtttgtccgaacgtcacggcttttattgggagttgggggtttggggtgccctgtcaggtgatcagaacattaaaaatggactcaacgtaaaataatcttctggacccttctaggacgacatggccgtgaccggtagtgctttaataccaattttaatcagttattaattgcctaactatggttccatcaattgcttaccttgc

SEQ ID NO: 367805 - DNA, 5825 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367806 - DNA, 5674 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacaccaccgtgtgacacgaatgttcaggtacacgctcgatt

SEQ ID NO: 367807 - DNA, 5586 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaaatcctaacaccgggccggtaccagcct

SEQ ID NO: 367808 - DNA, 3226 bp, Homo sapiens
agaggatcacccagtttcacggggatgccacggaccccctgtattggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367809 - DNA, 1942 bp, Homo sapiens
gggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacacgttgctgtagggccgccggagcgtgggcggacgcatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367810 - DNA, 808 bp, Homo sapiens
  misc_feature (4)..(4): n is a, c, g, or t
gctntacctaccctctctaatggcccctcctgcaggtacacacccagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367811 - DNA, 1770 bp, Homo sapiens
gggacagtgggctcccaggggaatgcaggttgaccacatctggctcctgccaggcaacgagcagcatctggcagagtaaggggccaacgcccatgggggatggaccctctcagttcttgggaattctgccccaaaagtcctttccctggggtctcagagggcccccgtccttcccttcttggtgtcactgtggcccctcactgctcttttcctattcaaacctgagtcccaccaggcccagggcttcacctgctgagctgttgtgtccttgcctgtgacgaggcctggccaggggtgcaggagcagaaggtggggagggttatagacgctgcaaaggccaagagaacatctgagagtggcagctggtgacctggccagaggggctggtgaggggcagagaacctggctagaggctgggtccctcaggtggtcctctcaggtgggaggcgagcagcaggtgtgggtgaggggaaggttctgatgacagctgcagaggcagggcccagtgctggcaggtggggggccaagaccctcccctggtgggacgttgaagccaaggatggccttggaccctgtcaggcccagcatggtcccgccacctcccccaccccacaggtggtgttgggacacctgggcgagatgtgagggtgggctcacttgagccactgaaaccagccaggtcttccctcaggccggacagatggcgcctgaccgaagttcctggcacctggaaaacccacaggtcagagtaaggggagaaaggaccctgccctccctgttccacgtctgtggggggagaggacaaatgccaggcacagggtaggcggcgagaacaaggcactcaatgtgtagctggggcagagactcggcctctggggagctgagcgggttccctccacccccaaccgtggtggaaagacaagctcgctggggcggggtgggggtctggtctccacctgcccctcccactcagccactgaggacaaggtggggcccaggcttctgggagggggagctggcacaaaaggaagtcctggggttgatgtgtttgagcgttaggcgaagtggttccccccatcccccaaacggaaaaatgtcagtatttgctaagctgtagagacctgatgccgtgatgtggcctgttccgcctccacccattacacggggataacgctggggggtggcgggcccacaaaagaggtgctggaggagactctcccacccctggccgggccggggctttggggccggaaggttcacagtacgcggtttgtccgaacgtcacggcttttattgggagttgggggtttggggtgccctgtcaggtgatcagaacattaaaaatggactcaacgtaaaataatcttctggacccttctaggacgacatggccgtgaccggtagtgctagaaaccagtcttcgagcccccagtgccacaccatgtccccccacctgcatacctgtggtctccccctgccaggcaccctgtgctgggcacagggacatccctgccaggcctagagggccttgtgtttttaaggcagtcaaatcttgcagcctggttcagtgccagctccaagggctattgggtagctgcaagggtcaattatgcattcctgtgagtcaggtttttccaacccaggcccttgactctgccctgagcttgcagctggatacaaagtgcaaaaaagcttggctccttctgtattctttaaaaacaaaacaacaacaaaaaaaaactgtaaaaacagcctccatgtccacgccct

SEQ ID NO: 367812 - DNA, 393 bp, Homo sapiens
gcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctgggtgagcctgcagactctctggccctgtcgccccctctcccccaggtctttgggatggatgggctttccctgcctccctctcccttttctcgggggttctgggtgcccgtgggaaacgggcctttgtctgctccttccccacccacttgggattccccataactgtggtaccctgagattctgggacccccccccccttaccttccttg

SEQ ID NO: 367813 - DNA, 426 bp, Homo sapiens
gtgtgagcgtccacggtgggcgtgttgctgggagaaagtggagtctgtccagccctgacccaagtcccaacctcctgttcccagggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtatgagggcacctcccactgccacatggacacctctgagctggtgttctggggtcccaggcagtcctctggtgggagattgcgggtgcttttgaggagcttgcctaagtatacaccaccactgggaggg

SEQ ID NO: 367814 - DNA, 293 bp, Homo sapiens
gtgagtgatcaggtggtgggggggactcacgggggagggggctccgctgactctgtggcctcctccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgagccttggccggggcttgggagaggggaggggctctgcggtgtgggggctgcggagtcagtaacccgcccttccccaggtgaagacaacg

SEQ ID NO: 367815 - DNA, 6340 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaaaaaaaacaagacaaacaaacaaaaaaaacacacagcacttgtcgcgtggccacaagcatcaatgccggctcactggtctgcccccttttcacgggacaccgcggcccatagagttaacatcgaacggacgagcacacaaaggaaatataggctggcaacgcgggactaatcacacaaaccacaacacataatcacatataaacaaagaagacataatagcatga

SEQ ID NO: 367816 - DNA, 4803 bp, Homo sapiens
taaataggctagagaggctgggttatcggccgaggcggagcctgtcatccaggcttcataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367817 - DNA, 6194 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367818 - DNA, 6275 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgagccttggccggggcttgggagaggggaggggctctgcggtgtgggggctgcggagtcagtaacccgcccttccccaggtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367819 - DNA, 6423 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtggtgttgggacacctgggcgagatgtgagggtgggctcacttgagccactgaaaccagccaggtcttccctcaggccggacagatggcgcctgaccgaagttcctggcacctggaaaacccacaggacgacatggccgtgaccggtagtgctagaaaccagtcttcgagcccccagtgccacaccatgtccccccacctgcatacctgtggtctccccctgccaggcaccctgtgctgggcacagggacatccctgccaggcctagagggccttgtgtttttaaggcagtcaaatcttgcagcctggttcagtgccagctccaagggctattgggtagctgcaagggtcaattatgcattcctgtgagtcaggtttttccaacccaggcccttgactctgccctgagcttgcagctggatacaaagtgcaaaaaagcttggctccttctgtattctttaaaaacaaaacaacaacaaaaaaaaactgtaaaaacagcctccatgtccacgccct

SEQ ID NO: 367820 - DNA, 6172 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtggtgttgggacacctgggcgagatgtgagggtgggctcacttgagccactgaaaccagccaggtcttccctcaggccggacagatggcgcctgaccgaagttcctggcacctggaaaacccacagcagggcacgagtgacctgagaggcccactcaggcagaagagacgcaagctgggccgtccaactggtttcaactgccagctttaccaatgcagcatttattttaaaattaaattaaattaaaaaaaaaagattgcatca

SEQ ID NO: 367821 - DNA, 5662 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccactcgcgcaagactgggatcctc

SEQ ID NO: 367822 - DNA, 5270 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggagtgcaggcgagtttctagaaccagagtctatataaagagagaactaacgccaaaaa

SEQ ID NO: 367823 - DNA, 2702 bp, Homo sapiens
tagccaggctgtcaccgcgagtaaggatatgtcgaccgggcctccgggaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367824 - DNA, 3444 bp, Homo sapiens
ggaagatggcggcgggaacctggtcgccgtgccgccgcgccgccgccgcggagcgaaccaggggtgtccggggtgcgcggtccaggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccaggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccaaaaa

SEQ ID NO: 367825 - DNA, 343 bp, Homo sapiens
ggccctctacctggagcccacggaggacctggcccccgcccaggtgcgcagggactccctgggctgggggctgggggctaggggctggggcagcgtggccccggctcatgcgtgtggtgccgtggcaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcggga

SEQ ID NO: 367826 - DNA, 1075 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggtgagattacaatctttcctttccgcagcaacttcatgaaacagaaggggtaaagccccctatttcccaaacagggccaggatgacaggaaacgaagcgtttagccggtttctgttgtcccgtgaaagcttttccacccctcctttccttgtcaggggcttgcagctccatctttgccattaagaacaaaggcaagaagccactttctctctgcctttccttgctcatgagtggatggagcttgggggttcatctcccctactccccaagtcctgttctttctaagccctttgcatggtgtggtcctccttccccagcctccttctgtggttctcctgcagaggggagtgggagcttggagtctcatccagtcagcgatgaggccggtttcctccgtttgaggctgtcttgaatcttttgcctgacggagtcaaggctcctggagaattctcctgggagggagtatttgccttttaaacgggcagaaggtggccgtatccgtgaaggaggaaacaccggagtttatgtaacgtggccattacaacacagggacaaatgtcacgtctgggcgccccccgtcccaaaactcccagctcctcaaagggaccctaagccaggcctcctcctctccatctcctcctccaaagtggtcacaagttcaagagtaacaacgctttgcacttctgcagcgctttccaggtttcaaaaataaataaaacctaacagtctctgagcgttgactgggggacaggcacaggctgggggct

SEQ ID NO: 367827 - DNA, 1301 bp, Homo sapiens
ggggggtgcgtggggcgtgggggtgttgccacgagaggagagggaggcccagcagggcccggggtcccctaaccaggctgaggttcagcccgggtggtcccggctcccctgtccgccacgctgggcgtcttccgttcgctgcccgctactctgtgtccgggggcttcttttcctcacaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccaggtacctgcccgggaccccgggaatccccgctcctggcgctgacaggaagcggctgagacactcgtggcgcacgtgcggccgcgcgatgccggccggccccgctccgcctccgcgccgtccgattggccagggctgtctccaggccgcggggctcaaagcctattggccgccgccgccactcgtatgagctcatccgccgcgagcgcttgtaaacaactgcgcggggcgaggctggggtgaggctaggtctctccgccgcgcgtcctgaggagtggcttttggcccctcagcgtttattgaccgtttgcggagcgtctgcagtgtgctagacccacactgctcacaaccccagctccccaacctcccctgacacacaccgcgggaagaagtcgtttgaggcatctgagcttcagagaagttaagcgatttaccaaaggcaatggcaggggacagatttgaattcacgtttcttagattccagagcgcaggctttttgctcccaaagcagcaagagagttttctaggtttaaatgggataatcaaaataaagcatttattttttattttttattttttgagacggagtctcgttctgtcacccaggctggagtgcagtggcgcaatttcggctcactgcaacttccgccttccgcgttacagtgattctcctgcctcagccgcttgagtagctgggataacaggcgtgcaccaccacgcccagctaatttttgtatttttagtagagacggggtttcaccatgttggccgggctgctctctaactcctgacctcaggtgatccgaccgtctggcctcccaaagtgctgggattacaggcgtgagccaccgctcccggcacaaagtaaaacattttacctaaggactg

SEQ ID NO: 367828 - DNA, 2453 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctggggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367829 - DNA, 2112 bp, Homo sapiens
cgccagcacacccgaacttacagccagtacgagctgcggttatatcggccgaggcctgcagagaagttgcaaccgagaggggccttgggaaatagcaaggatttggacagataaagacgtgggagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367830 - DNA, 1758 bp, Homo sapiens
agctatgcaggaggcatagcctgaagtgtttgtttgtttttttcctgccagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367831 - DNA, 2520 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctatcccccattctcctcctatccctcaaccccgacatcattaccgggttttcgtctt

SEQ ID NO: 367832 - DNA, 1269 bp, Homo sapiens
atcagtttacacaaagtggtagttcctcctagctgtaggagggtgggctgtcctgcaccagtgtctgcatgggctcctgcccactggggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367833 - DNA, 2189 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagccctctgtgggcctggctgggtccggcctatctaagcatcaggaccttgaagggtctttacctttgccaggaccgggggaatgctgcgggctgcctttggtggagcctccggggctttccgcggtcccggctcggggcccgagggccaactcccccccgggggggtgccgccccgtttggaatcttttttcagggcgacg

SEQ ID NO: 367834 - DNA, 1776 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367835 - DNA, 941 bp, Homo sapiens
cgtctgcagtgtgctagacccacactgctcacaaccccagctccccaacctcccctgacacacaccgcgggaagaagtcgtttgaggcatctgagcttcagagaagttaagcgatttaccaaaggcaatggcaggggacagatttgaattcacgtttcttagattccagagcgcaggctttttgctcccaaagcagcaagagagttttctaggtttaaatgggataatcaaaataaagcatttattttttattttttattttttgagacggagtctcgttctgtcacccaggctggagtgcagtggcgcaatttcggctcactgcaacttccgccttccgcgttacagtgattctcctgcctcagccgcttgagtagctgggataacaggcgtgcaccaccacgcccagctaatttttgtatttttagtagagacggggtttcaccatgttggccgggctgctctctaactcctgacctcaggtgatccgaccgtctggcctcccaaagtgctgggattacaggcgtgagccaccgctcccggcacaaagtaaaacattttacctaaggactggcacagagcgtacgcttagatgtgagctgctcaaaggaagcatgggttgtttcctgaagtagaagtggggggaatcccctgcagaagaacgcaaccgagaggggccttgggaaatagcaaggatttggacagataaagacgtgggaggtaggagagaagcccttccctacggccttcctctctcatttgccttgtccctgagatggttcagccctctcaggcctgatcttacctctggggcagaatttgactttgggttgtgtgtggggggaaattcttaggtgacccaccttcatctaccctaacactcaggccaggttcagctgtggaattcactcagggcagtccctgatgagagctgtttccca

SEQ ID NO: 367836 - DNA, 2532 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367837 - DNA, 2479 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367838 - DNA, 2498 bp, Homo sapiens
ggggggtgcgtggggcgtgggggtgttgccacgagaggagagggaggcccagcagggcccggggtcccctaaccaggctgaggttcagcccgggtggtcccggctcccctgtccgccacgctgggcgtcttccgttcgctgcccgctactctgtgtccgggggcttcttttcctcacaggctgtttctgggacaacggccacctgtaccgggaggaccagacctcccccgcgccgggcctccgctgcctcaactggctggacgcgcagagcgggctggcctcggcccccgtgtcgggtaagtgtcctccgggggacggcgccggggctggcgggcggcggccgcgttcccggtgccagccccggcacacatttccttctctcctctcttaggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaatgccaag

SEQ ID NO: 367839 - DNA, 2011 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcagcaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaaaaaggctctaaagaaacacaaggaaagaatagggcacaggtggggatggatggttggttggatatgtcacttttcttatggtaaacagttaaatccatattctctctgcttaaaagaagaaattaatgttttgtagtcctaggttcagagccagcctaagaccagagccgg

SEQ ID NO: 367840 - DNA, 1430 bp, Homo sapiens
ttagattttgcatgacctaggaggcttaggacccagggggcgcctttcagctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccaggtacctgcccgggaccccgggaatccccgctcctggcgctgacaggaagcggctgagacactcgtggcgcacgtgcggccgcgcgatgccggccggccccgctccgcctccgcgccgtccgattggccagggctgtctccaggccgcggggctcaaagcctattggccgccgccgccactcgtatgagctcatccgccgcgagcgcttgtaaacaactgcgcggggcgaggctggggtgaggctaggtctctccgccgcgcgtcctgaggagtggcttttggcccctcagcgtttattgaccgtttgcggagcgtctgcagtgtgctagacccacactgctcacaaccccagctccccaacctcccctgacacacaccgcgggaagaagtcgtttgaggcatctgagcttcagagaagttaagcgatttaccaaaggcaatggcaggggacagatttgaattcacgtttcttagattccagagcgcaggctttttgctcccaaagcagcaagagagttttctaggtttaaatgggataatcaaaataaagcatttattttttattttttattttttgagacggagtctcgttctgtcacccaggctggagtgcagtggcgcaatttcggctcactgcaacttccgccttccgcgttacagtgattctcctgcctcagccgcttgagtagctgggataacaggcgtgcaccaccacgcccagctaatttttgtatttttagtagagacggggtttcaccatgttggccgggctgctctctaactcctgacctcaggtgatccgaccgtctggcctcccaaagtgctgggattacaggcgtgagccaccgctcccggcacaaagtaaaacattttacctaaggactg

SEQ ID NO: 367841 - DNA, 3747 bp, Homo sapiens
cagagtaatgacatggttccttccatcctccaaaggtgaccaataatagtttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatatttgtatgtcttatgctgaaaaatcttgtttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatattaacttaaataggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaaaggtgg

SEQ ID NO: 367842 - DNA, 471 bp, Homo sapiens
taactgaacataagccacatcattatatctcaggatttaattccaagaacaacacccttgtacataaccagggcattaaaaacacaaagtaggcccaatggtagttggtgttaaaggctcaagaattgcaggctgttgtgtgtgcacacaggtgcatctgtggatactatgtatgctacattgtacatactatgtatgtacaccatgttacattgtagctaagtcagtttagttaatacaagaattgcccattacattatcaaatagcttaactgaaaagtaatgtttgcattatatctgatagcttccatatagaagaaagggaagggccaatgaagactcttggaagctagggaccaagtgcagtctttagatgggctttatgttacctctcatcttcaggtgggtaaaacttgtgttccaatacttgttgatgttaatgtagattttggcagagttcttgttttctgt

SEQ ID NO: 367843 - DNA, 3374 bp, Homo sapiens
ccgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcagcttccatatagaagaaagggaagggccaatgaagactcttggaagctagggaccaagtgcagtctttagatgggctttatgttacctctcatcttcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaaaggtgg

SEQ ID NO: 367844 - DNA, 3276 bp, Homo sapiens
ccgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaaaggtgg

SEQ ID NO: 367845 - DNA, 699 bp, Homo sapiens
ccgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaaaggtgg

SEQ ID NO: 367846 - DNA, 3667 bp, Homo sapiens
actcgagcctagggaggcgaggttcccgcaccggataggaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggca

SEQ ID NO: 367847 - DNA, 4527 bp, Homo sapiens
ggcacgaggagagagtcctctggtcctctcttgccatacacactacactgtgccttctacctcgcatcaaaacgctcaatagacgttgcgatgatgcgactgaagattatgcaacgcgttccatccggagcggccagcatgaccagctggccaggggctgactcctgccttttgttttgtattgacgagacccttgcgagttctaattctgatttgcacttgccctgaggtgcctccactgctcttatatgggagacactcttaatttaacagatgaaaatattctgatactctgatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacaaaaaaaaaaa

SEQ ID NO: 367848 - DNA, 1253 bp, Homo sapiens
actcgagcctagggaggcgaggttcccgcaccggatagcatgtttttggcccagaggagcctctgctctcttagcggtagagcaaaattcctgaagacaatttcttcttccaaaatcctcggattctctacttctgctgaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtccactttcacaggaaactttttggggcgggaaaagccatcaaggtggcaacaagccaccaaaccatcatttgaaagtgcgctttacgtaacccggcttggggggatccccgctccctcacatcgctgttttcggccgaagtaagggcgcatcacaaaaaacctgcggtgggggggggcggcgcgaagtcaagctttttttaacgccacgcgtcccctcccatagcacgtggcttcccttcttccaaagcggcccaaaaaaccggggggcgtggggaacaccccagggggcgggcgtcgccccctcttttgggggcggcaacacaatggcaccggtgccaccgccgccacatcgtcgcgccacggtgggaacccccaacgggcgggggggcggctgggaaaatcccccccccggattttttccccgcccaccccctttcccaaccgggggggcagggaacgacccacactttggtgcgcccacttcttggtcaaaacccccgggacggtggcctttgcgggctgtgacgcgtcccccaacacttctttacacaaccagttttttttacgtacgtacagctcagatcagagcagaatctacaaaacagacaccacagatgcaagcacacatctactcaaaatacgacgatcactcctaca

SEQ ID NO: 367849 - DNA, 4759 bp, Homo sapiens
actcgagcctagggaggcgaggttcccgcaccggatagcatgtttttggcccagaggagcctctgctctcttagcggtagagcaaaattcctgaagacaatttcttcttccaaaatcctcggattctctacttctgctgaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacaaaaaaaaaaa

SEQ ID NO: 367850 - DNA, 1256 bp, Homo sapiens
aagaaacaagctgggcagctctgggagagaggagtgtcagacagctgttgtcaacaggcacctggccagagtgaaaaggaggggcagattccatccaagtcccagcggcgccagctgacactctctgccaatgcccaggtgctgagcgacagtgtcccaccggtccctgtgcccagaatggcctgcaccaagaccctgcaacagtcccagcccatctccgcaggagccaccacaaccaccaccgctgtggcccctgctgggggtcattctggctccacagaatgtgacctggagtgtctggtgtgccgggagccctacagctgtccccggttgcccaagctgctggcctgccagcatgccttctgcgccatctgcctgaagctcctgctgtgcgtgcaggacaacacctggtccatcacctgcccgctgtgccgcaaggtcaccgccgtccccgggggcctcatctgcagcctgcgcgaccatgaggcggtggtggggcagctggcccagccatgcacagaggtatcgctctgtcctcaggggctggtggatcctgctgacttggcagcaggacaccccagcttggtgggagaggatggacaggatgaagtaagtgcaaaccacgtggcagcccggcgcctggccgcgcacctactcctgctggccttgctcattatcctcatcgggcccttcatctacccgggtgtcttacgatgggtgctcaccttcatcatcgccctggccctgctgatgtccaccctcttctgctgtctccccagcacccggggcagctgctggccctcctccaggactctcttctgcagagagcagaaacacagccacatctcttccattgcctgagtgccctctgatgaggctatccctgcagccctttctgcccttgggcccccggacttccacaatgaacagggtaaggggttacggactaagactggctcctttgggaaatcacatgccagcgggacttgcaagccacaaccgagatggccagcctgggtcaagaattacacgcttggatgacaggcttgcacttgcccttgggatagcatagctaaaactgttggtggctaggggagcagacacaaactacttgaacatgacaagatgggggaagctcctgttcctcttattccaatgttcttggtttttctttatataacttgatgaaagtattgcagtattgatgccattgtagaatagaactggaattccattctttttgcaatttaaaaaaa

SEQ ID NO: 367851 - DNA, 813 bp, Homo sapiens
attattctttcaggttgtctttatggtttttttttaaaaattgcaacagaataaacggttttgcagttattttgtgtgaacttttaaatgctatagaaagtaatttacctaaaacactcaaactttaatcactataaataaaaaaaagtaacgaaaatattttctttaaaggctttatttgcattcttgtaaattttattatttcaagtcaatgtgttaagaattactgcgcatatagttatttcttttataaatttgttttccgtgattccttcaaaagctttcttattgttggcctttattttctgcagagaagactacagttttacagcttatgctaccatttcgtatttgaaaataggacctaaagctaatcttctgaacaatgaggcacatgctattactatgcaagtgacaaagtccacgcagaactctttcagggtaaatggctattaattttcagttttatatattttaaaaagtatattaaagcctatgggatgcttttctgtcatattcccctaggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgttttaaaccaaatactatcaagtctgcaaaag

SEQ ID NO: 367852 - DNA, 3807 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaacttagaatttatgtttttatatttttccactaatatcattatcacttctgtaattttcagtgtggtcatca

SEQ ID NO: 367853 - DNA, 3543 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367854 - DNA, 3832 bp, Homo sapiens
  misc_feature (35)..(35): n is a, c, g, or t
aagatggataagcaaaagcatttattggtcaatgngatatgttacggttgaggcatacccaggataagaactaagcaatactaaatcagttattacccgatatttactcttggctcaccatgtacatcaaacatttataaatctcaatgtgcttctggaatttgaataaggattttggagcacctcaaggccaatctgtgattaatgagaactgttgagttacttggcttggtgtcacagttgcccactggttgaaaaggctggctttagtatctctactatagccagggattcccactttatcatggctgtctctctctgaggcacttcttgccatttaattgtaggattttaatggggaagattttactcccgagtagcggaaagatctgctcgaggcctgggtgctttggtgtcggagatccgagagtcggagatcggagagtcggacacaggacagtcggacaccggacagtcaaacaccggagagttagactgggcttctcggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367855 - DNA, 1878 bp, Homo sapiens
attattctttcaggttgtctttatggtttttttttaaaaattgcaacagaataaacggttttgcagttattttgtgtgaacttttaaatgctatagaaagtaatttacctaaaacactcaaactttaatcactataaataaaaaaaagtaacgaaaatattttctttaaaggctttatttgcattcttgtaaattttattatttcaagtcaatgtgttaagaattactgcgcatatagttatttcttttataaatttgttttccgtgattccttcaaaagctttcttattgttggcctttattttctgcagagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367856 - DNA, 1909 bp, Homo sapiens
gggaaccctggtggacgatttccaaaaaaaaggggcataaaaaaatctatattattataacatgaaggcagaggagagtagactggatttgcaatgactctgaagtctacactaagtctactctgggtactctcctatcctgcgccaatggcagatctgtctatttgatcatagcactctctcctggtgatcctaggcatagccccactatcctcagagtagggcttcctgtccttgttgttgcttgagggtaatacttttttgcttccctagttctggggtgctttagagccacaagtaaagtaggatcctgtaagggaattactagggcaaatgaagcttacatcctcctatcctctgccccactccagattggacctggactttttcagcgatagggtatcactatgttgctctggctggcctccaactcctgggctcaaggggccctgatttttttttttttttgtaggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367857 - DNA, 2465 bp, Homo sapiens
  misc_feature (2460)..(2460): n is a, c, g, or t
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcgggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtatctgattccatatttgagtagcatagtttaaagatctgttttttgatgacaattcgantactt

SEQ ID NO: 367858 - DNA, 530 bp, Homo sapiens
cttccggtttccccactacaaacaaaaaaaaaaaaaaaaaaaaaaaaaaaaaaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367859 - DNA, 676 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcaggttagtagcaatgattacattttcttcttccttctgttctatttctgtttgtatgatatttgaaaaagtttgttttaaaaattctgattatagaaatgatttttttcagcttttttattgaagtaaaatacacattacaaactttgccatgcta

SEQ ID NO: 367860 - DNA, 387 bp, Homo sapiens
ggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgttttaaaccaaatactatcaagtctgcaaaagcatgtcaagtcaagtgccattgtgtctaaggacatttgaggtctttagaacttctctcacaacgtagccccttttattcaaaatagagctcatatttg

SEQ ID NO: 367861 - DNA, 3740 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367862 - DNA, 3938 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtgtaaactgattaatcagtttacacaaatccacatactgtacattcataggtgaggttaagcctgtcacccatttctttatttctataattacacaagcataataaatcacatctgattttaaaggtcacttaaaatgagtcataatttacagtacagtacgtttcagttcaagtgcaaaaaatacctatttgctgaattctatttctttcagttatttcattttgacgctgtgttgcatagtgaag

SEQ ID NO: 367863 - DNA, 3650 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcgggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 367864 - DNA, 2585 bp, Homo sapiens
tataagattattagtataaaattttagataggtaggagtagcggaaagatctgctcgaggcctgggtgctttggtgtcggagatccgagagtcggagatcggagagtcggacacaggacagtcggacaccggacagtcaaacaccggagagttagactgggcttctcgggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggtaaatggctattaattttcagttttatatattttaaaaagtatattaaagcctatgggatgcttttctgtcatattcccctaggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgttttaaaccaaatactatcaagtctgcaaaag

SEQ ID NO: 367865 - DNA, 475 bp, Homo sapiens
cataggcgatactggtgcacatgaacaatatttgttgatggaaaatgtgttagacgagtctggattcagtttggtatggaccatgacttaatgaaatagttgtatcatgatctttgtagctaacctgatggtttttggcctaccgcagcccaatgcttgatttctgactgaaaactgaacaagccttgtggtattcacccatctgaagatattcttgtattgcaagcatattaaggcatggaatgattacacataatatacctctacgatctagagagacagactgacatagatacatacacatgtaatataattatatttttctttacgatttctactgcctaacctctaaaaatgttttatatattactctaacctgttgtcctccacattctattgtcctaattgtactgttttctgatttgtatttatgtcttgagacagtaactttttgaataaaaataaacctacagta

SEQ ID NO: 367866 - DNA, 5794 bp, Homo sapiens
ctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367867 - DNA, 5879 bp, Homo sapiens
gtggcccaaaatggagaacgcggagcagcgcaagatggaggctccgcttctctgtgtagcagtagatttaggttccttttctccggcaggctcctaagcctaggagagcccgaactggaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367868 - DNA, 5575 bp, Homo sapiens
tgtcttcctcttcttttcatcattccatcctcctctggatctctacgactgaagagctttttgtagagaaattctccagctgctactgctactggagaattacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367869 - DNA, 5910 bp, Homo sapiens
aaccccgccggatccgaccgccactttcaaaaccccccaccgctctagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367870 - DNA, 4523 bp, Homo sapiens
ctgcttctcccccgccccatcatctccagcgcgtggtgggggaactgctggggaaggcgattggcatcgatctctccatcccttccgaggcccgacttcggtcagttttcttcgggcaacaagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367871 - DNA, 4483 bp, Homo sapiens
tcgatctctccatcccttccgaggcccgacttcggcacgaactgagctgatcctgccccaggaatagtcttagaagaaagaagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367872 - DNA, 5740 bp, Homo sapiens
ctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367873 - DNA, 5432 bp, Homo sapiens
tcaacatatgaaaaatcaatgtaatatttcatattaacagttggaagactcacaattcatagtttcagaatttacaacacaaacctacaggaataaagacaatgtagtattagaataaggtcagatatatagatcaatggacagaattgacagtccagaaatacacccatacgattacggtcacctgatttttgactaaggttccaaaacaattcactaggggaaagaatagtcttgtcaaaaaatggtgctcagacaagtggatagccataagcacagaatgagtttggacccctatctcaaatctcaaatacaaacattaactccgaattaatcaaatgcctaaatttaagagctaaaattttaaagctcttagaagaaaacataggtacacatctttgtgactttgaattaggtcacggtttccttgacatgacacttaaaagtacaagcaacaaaagaaaaaaatagataaaatgaacttcagcaaaattagaatgtttatgcttcagaaaacactgtgaagaaagtgatcagacaactcacagaatgggaaaaatatttgtgaatcatatctcttaataagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttaagcctcgcaaaatgagttgatgtcaaaatggcaagtagccactttctgttttcaactaatttatttgt

SEQ ID NO: 367874 - DNA, 2352 bp, Homo sapiens
atgatccatatattgcttaaacaataccagttatagtatcagagacaatggtaagattaatattctcaatacataccaattatcagtgccatggcactgctattacacaggcccagagcagacaaaatctggctcataatttgttggttggctaagactaagtcagcaacatatgcaggcgatccttggtgtagaaattgcacgttcaatttctgacaccactcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367875 - DNA, 2816 bp, Homo sapiens
gagatttaacttacaagtaagagctctttgtaatatttcagctcattacatctggctttgatatcagttcttaatagcttattatagtattctaaaatattacttaatgggcataagtgctagaattttaattgaacaacctaacttttagtatatatactaagagtcacatgccattcttgtttagtgaacaagggagagttgctccattcatcatctgcttttacttttagacaagtaattattagattttacctaacattcctttctcagttggagtatatagaaagcatcaatgtaagtcattttgcccagattttaccttacccttttgatttcttaaaatttgtagttctgttccattcactttggccagattttctaaagaaagcttcttgctttctacatacttgaattgttcttagattttttttggtctgcatactcaaatgcctttttgaaaaaccatatccacttcccagcacaaatagccaagtttgcaagactttcttaacccctttccaaggaacctgtgccagaaatatatgtgaagaagcacatcatttattcatttaacaaatacctatgttgagtgcctatgtttagggtattatctagacattagtggtacatataagcataattaatccaaggttcctactttaattatatgtgaggtaagtagcatcttgattagtcctgatgttatttcattatatatcatggtcaatttaattttagaattatacatctgaagagaggggaagttttcaaagtggttttattagcatgttatttaacataataaagtattaatgtaatatttatggatatatttaaagaaatgaatgacttttaacgagattttctcccctctctctctctcattaggttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367876 - DNA, 2992 bp, Homo sapiens
  misc_feature (2735)..(2735): n is a, c, g, or t
ctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggnacgaagactggcgcatcttgctcccatcaggtggtgatcttgtactgctgggtgttgaggaaccagggctaatgatcttagaaagcagggacatagtatctacactgctggatgtgggcttgtccatcatctcatccggggtgggtgtcccactccgttcatcccgtacaggggttccatcaatgttgtcgattgaggtgctagtagggccacgctggaagtctgagggatggctctctgatgtgacgcaagatgcg

SEQ ID NO: 367877 - DNA, 2264 bp, Homo sapiens
ctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctctatgggggatctcgcgagatcccccatacagagtagagtattacttgactaactataagggacagctatatctcccatcccctatttccaagcagtttctaaacaactgacattttacctccaggcaaaaaaacaagtcagcttttccctaaagaaagtgaaccactatctagggaaagctaagcggaggtgtggcacagagtaaacacatctcatccagcatttaaagggcccatacataacctagcagctagctcctctctcttttaccctaaaacaatctgccaagagacagatcctactctgtatggggatctcggggatcctca

SEQ ID NO: 367878 - DNA, 425 bp, Homo sapiens
acagttatttaaaatatgttggttggactatgcatgataaggtaagatgtgcccttcagactgcttctttctacacatcggcgtggctgtctgcacctctcattcatgagttatctcccagtatgtatacctggtgacacatttctggaagcctcccctttattcttttctatcttctctgtaaaaacttattttctatcacataaagtctgctagatatttttgaatcctggccactgatttaaccattaatggtgaatcatttttttgctgaaatattacagtcatgaaggtagtaggagtgaggcatttcttagggcacgaagaagaaccattacgctgttgttatctgagagctatatacttaaaaaaaaaattattcaattttgatcctctcttttgacaaacctgtatcttagccagat

SEQ ID NO: 367879 - DNA, 6039 bp, Homo sapiens
tcaacatatgaaaaatcaatgtaatatttcatattaacagttggaagactcacaattcatagtttcagaatttacaacacaaacctacaggaataaagacaatgtagtattagaataaggtcagatatatagatcaatggacagaattgacagtccagaaatacacccatacgattacggtcacctgatttttgactaaggttccaaaacaattcactaggggaaagaatagtcttgtcaaaaaatggtgctcagacaagtggatagccataagcacagaatgagtttggacccctatctcaaatctcaaatacaaacattaactccgaattaatcaaatgcctaaatttaagagctaaaattttaaagctcttagaagaaaacataggtacacatctttgtgactttgaattaggtcacggtttccttgacatgacacttaaaagtacaagcaacaaaagaaaaaaatagataaaatgaacttcagcaaaattagaatgtttatgcttcagaaaacactgtgaagaaagtgatcagacaactcacagaatgggaaaaatatttgtgaatcatatctcttaataagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367880 - DNA, 6203 bp, Homo sapiens
tcaacatatgaaaaatcaatgtaatatttcatattaacagttggaagactcacaattcatagtttcagaatttacaacacaaacctacaggaataaagacaatgtagtattagaataaggtcagatatatagatcaatggacagaattgacagtccagaaatacacccatacgattacggtcacctgatttttgactaaggttccaaaacaattcactaggggaaagaatagtcttgtcaaaaaatggtgctcagacaagtggatagccataagcacagaatgagtttggacccctatctcaaatctcaaatacaaacattaactccgaattaatcaaatgcctaaatttaagagctaaaattttaaagctcttagaagaaaacataggtacacatctttgtgactttgaattaggtcacggtttccttgacatgacacttaaaagtacaagcaacaaaagaaaaaaatagataaaatgaacttcagcaaaattagaatgtttatgcttcagaaaacactgtgaagaaagtgatcagacaactcacagaatgggaaaaatatttgtgaatcatatctcttaataagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatc

SEQ ID NO: 367881 - DNA, 5955 bp, Homo sapiens
tcaacatatgaaaaatcaatgtaatatttcatattaacagttggaagactcacaattcatagtttcagaatttacaacacaaacctacaggaataaagacaatgtagtattagaataaggtcagatatatagatcaatggacagaattgacagtccagaaatacacccatacgattacggtcacctgatttttgactaaggttccaaaacaattcactaggggaaagaatagtcttgtcaaaaaatggtgctcagacaagtggatagccataagcacagaatgagtttggacccctatctcaaatctcaaatacaaacattaactccgaattaatcaaatgcctaaatttaagagctaaaattttaaagctcttagaagaaaacataggtacacatctttgtgactttgaattaggtcacggtttccttgacatgacacttaaaagtacaagcaacaaaagaaaaaaatagataaaatgaacttcagcaaaattagaatgtttatgcttcagaaaacactgtgaagaaagtgatcagacaactcacagaatgggaaaaatatttgtgaatcatatctcttaataagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttacagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367882 - DNA, 5722 bp, Homo sapiens
gcacgaactgagctgatccttgccccaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367883 - DNA, 5905 bp, Homo sapiens
ctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataacacgcaggtaacatggatgttagctcaaagacaacaagaggaagcaaggcaacagcaggagagagcagcaatgagctatgttaaactgcgaactaatcttcagcatgccattcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367884 - DNA, 2747 bp, Homo sapiens
aaatacggctagtaagaggcccggttactcggacgaggtcgaacacaagagattaacattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagta

SEQ ID NO: 367885 - DNA, 5036 bp, Homo sapiens
tcaacatatgaaaaatcaatgtaatatttcatattaacagttggaagactcacaattcatagtttcagaatttacaacacaaacctacaggaataaagacaatgtagtattagaataaggtcagatatatagatcaatggacagaattgacagtccagaaatacacccatacgattacggtcacctgatttttgactaaggttccaaaacaattcactaggggaaagaatagtcttgtcaaaaaatggtgctcagacaagtggatagccataagcacagaatgagtttggacccctatctcaaatctcaaatacaaacattaactccgaattaatcaaatgcctaaatttaagagctaaaattttaaagctcttagaagaaaacataggtacacatctttgtgactttgaattaggtcacggtttccttgacatgacacttaaaagtacaagcaacaaaagaaaaaaatagataaaatgaacttcagcaaaattagaatgtttatgcttcagaaaacactgtgaagaaagtgatcagacaactcacagaatgggaaaaatatttgtgaatcatatctcttaataagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatata

SEQ ID NO: 367886 - DNA, 341 bp, Homo sapiens
ggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaact

SEQ ID NO: 367887 - DNA, 182 bp, Homo sapiens
aattcaagcttctaacgatgtacggggacatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367888 - DNA, 1459 bp, Homo sapiens
tacgaggcctgggtgttgaaatcggccgaggggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367889 - DNA, 2464 bp, Homo sapiens
tgcgcatccctcttagtgctagtggcggcaggtgcaggtggccgcgcggcatcctggggattgcagtctcccgagcgttctattgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacatattcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaaaatatgcggcaaggttttttgtttgtttggttctcctggtcgagatgttccact

SEQ ID NO: 367890 - DNA, 1388 bp, Homo sapiens
gctcgcgatctagaactagttccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367891 - DNA, 2356 bp, Homo sapiens
tgcgcatccctcttagtgctagtggcggcaggtgcaggtggccgcgcggcatcctggggattgcagtctcccgagcgttctattgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacatattcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaacccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367892 - DNA, 1020 bp, Homo sapiens
gtgcgggtgatctagaggatcccgggtcatcgatgcacggggaatctttctgggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367893 - DNA, 657 bp, Homo sapiens
aattcaagcttctaacgatgtacggggaatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367894 - DNA, 152 bp, Homo sapiens
ccttcaagccctaggtgtagccattttgtcaagtcatcaactgtatttttgtactggcattaacaaaaaaagagataaaatattgtaccattaaactttaataaaactttaaaaggaaagaaatgtgctgtgatggcctttttgttattgga

SEQ ID NO: 367895 - DNA, 407 bp, Homo sapiens
gaaaagggagtcaaccatgtggataataatggggaaagtgtgttcagcagagagttaagagcaagtccaaaagcctgtgttaggattatccctggcttgtttaatgacagcaacagcaagaggtcagtgtagctgaagaggacttaacaaggggtaggacattaagttagagaagtgcctaggtgatagatcatgtagggccttataggccactgcaaggacttggggttttgccctgacaagtggggaagccactgaatggttttgaggagagagaggacgttatctgacttaaggtttacatttaatcttaataggatgaagaggaacccaaagatgaagatttcagccctgacgggggttatattccacgaatcctttttctgggtaaggcacatgatcttaac

SEQ ID NO: 367896 - DNA, 334 bp, Homo sapiens
tcctccaatctttatttcacagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaa

SEQ ID NO: 367897 - DNA, 2410 bp, Homo sapiens
tgcgcatccctcttagtgctagtggcggcaggtgcaggtggccgcgcggcatcctggggattgcagtctcccgagcgttctattgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacatattcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367898 - DNA, 2629 bp, Homo sapiens
tgcgcatccctcttagtgctagtggcggcaggtgcaggtggccgcgcggcatcctggggattgcagtctcccgagcgttctattgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacatattcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaaaaaaaaaaaaagaaaaaaaaagaaagaaagaaagcgaagacaacaaagaaaaacaaaaccaagagaaaaacaaaaaaaagaaaaacaacacgaggcaaccggcgcaacacgaaaatcggtaacagaagcaggagaagaagagctaaaaacaaagacaaggaacaaaacaaaacgacaagacagcagaagagatggcacaatgcggaaagaaccgaaatc

SEQ ID NO: 367899 - DNA, 2563 bp, Homo sapiens
  misc_feature (2419)..(2419): n is a, c, g, or t
tgcgcatccctcttagtgctagtggcggcaggtgcaggtggccgcgcggcatcctggggattgcagtctcccgagcgttctattgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacatattcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaaaaaaaaaanaatgcggccgccattttttttttgtttatatagtgaccaccgtggaaacaaacgcctcttgtattgttatgtacatagtccatacctgagtgctgtacataagttgttctgtgtataaataaaacaagcctgtttttgatcttc

SEQ ID NO: 367900 - DNA, 1423 bp, Homo sapiens
aacagactgatgtaacgagcgtcgatcactccggtttgtactttcaattccgggcctgggtttgtcacatgtcccttagtgtgccccttgacttacaggacatagaagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 367901 - DNA, 7708 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgaggttcagatggtgtcatctcagtagccacacatggttggatcatgtatttagaccccccacctgtgttcctcaatcacactgaagccacagctgggcccaccgaggtgctatcctgcccaggccagcacttggctgagttgggttggagtacacacctggtgtgcagggtgaagcagctcattttgtctggtcctgatcccagactcaccccatctgcagcaagacccttggctggcttcctccgctctgggtgtctcccacatgtctactatggcaaaaaacattaccatccccacccataccacagcatcccctagagagagtgaggtgcagggacccgagggccaggttagcacagcgctggccccagcatggagggaagccctgtgggccacggtaggctagaagggaattcgagctgggcatgaaaaggatgctccggggccattgttagtgggtttggggctgaaatgagtgatcctgcctctggtcccagcatccagctgcctcgttgtctatcctgggagggtgtggtgcttcggacacgttgaggggctttgtcagcatcaggaaggcctttgcttcttgcacccaggcccagctgagacaggcccctgagtcctggctcatgttctggcagcaaacttcacttttcctaaggaagggaagaaggaggcagcagggaagcaaccctgggttttcagaaggtccttctgatggctaggctaaggggaggaagaattcctgccatgccccagccttctccaggacaacctgctggaacgcagtggtgttttcagggcactgtgtttgccttgcagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccacggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgcgttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367902 - DNA, 6694 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccacggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgcgttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367903 - DNA, 449 bp, Homo sapiens
cctgcctcctacctctgtggctgcccaggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtcagtgggggagtctgcagcccttgcctcaatggcacaccctcacatgtgtacagacagcacccctgcacgccaccctcaggtgcttgtacccagacgcaaactgcatgcctgaccctgccataccctgcatgaacactcgggggtgcactcccaccagagacaccacattcagcacctctgcacaagtggctcacatggg

SEQ ID NO: 367904 - DNA, 250 bp, Homo sapiens
acgttgtgttcacatacatgcatgcacgtgctccataaatgtccccagacttccctttccctcttagtccccactgctgagatgctggtggaggctgatgcattcctgtgagcacctccccttcccacacacacagactccgtcctcctgtgcaagctcagggtttgtgtcccagctcaggtgagcccatggggttgccataattgtaagacactccaggttctaacgtaaaatttcctcttctgactta

SEQ ID NO: 367905 - DNA, 6296 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgaggttcagatggtgtcatctcagtagccacacatggttggatcatgtatttagaccccccacctgtgttcctcaatcacactgaagccacagctgggcccaccgaggtgctatcctgcccaggccagcacttggctgagttgggttggagtacacacctggtgtgcagggtgaagcagctcattttgtctggtcctgatcccagactcaccccatctgcagcaagacccttggctggcttcctccgctctgggtgtctcccacatgtctactatggcaaaaaacattaccatccccacccataccacagcatcccctagagagagtgaggtgcagggacccgagggccaggttagcacagcgctggccccagcatggagggaagccctgtgggccacggtaggctagaagggaattcgagctgggcatgaaaaggatgctccggggccattgttagtgggtttggggctgaaatgagtgatcctgcctctggtcccagcatccagctgcctcgttgtctatcctgggagggtgtggtgcttcggacacgttgaggggctttgtcagcatcaggaaggcctttgcttcttgcacccaggcccagctgagacaggcccctgagtcctggctcatgttctggcagcaaacttcacttttcctaaggaagggaagaaggaggcagcagggaagcaaccctgggttttcagaaggtccttctgatggctaggctaaggggaggaagaattcctgccatgccccagccttctccaggacaacctgctggaacgcagtggtgttttcagggcactgtgtttgccttgcagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctgggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccacggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgcgttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcactttt

SEQ ID NO: 367906 - DNA, 4102 bp, Homo sapiens
aggggacagggctgtaggtaccctgggcttgcccacatgaggcccagcaactgggagccatgccagcatgccgctggccagggacggtttgtgcagagtttgaggcctctctcagcatcatgggtgggcaggaaaggtgggtctgtggttggcagctcaatgaaacaggagtctgaggatgaagcctggtgtctgggcagcttctgcatgcccacccaagatggctccctgggcagggccaagggtggtgtgttacatagtaccaatgggcacaggacagtgttttcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtgagctcttccggcctggggtgggggccgcagccactgctccctcctgggtagcatgctgcctactcagcccagggatcagctgtgatcagacttgggctcagtaggtggaaagggagattccacggaagaggcatcgcctgcaggactttgcggtgggacccctgaaactggacctgcatagctacgtgaggcctgcacagtgagtcagctggggtgccccatctcctttcatccccatggggtgcaccctcaccaggcactggtggagccaggcagggttctcagagcaaaaggacgggcatgggtggagaagtcagcagaggagcccagggaaaggctggcccgaggctggatgagcagagtgggggcagccagaaggccccaggcgcccggcttgccccaacaatgcctattgctgggcaggctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367907 - DNA, 393 bp, Homo sapiens
gtaagttcagtaagaaatctcaaaagtttctctgctatccaccaaagaaattctaagccatagggccaggcatggccccacctgacctttctggatggatggtgtcatttccccccaggctctggcatgcttacctggagtcgccacccttgcagcctgctcccctcgcatgcccttttcctgccatcagcgcggctttggcgccagaaggcacttacagagccagccctggcagggctggggtctgtaccagctgagctcaagccctggtggctggctgctcccaggatcctcacttgtcacttttgtcatgcacagggatgttcccaggaaaaggtggaatggtggctcctggaatgacctgccagtacattgtccagttttttcccgact

SEQ ID NO: 367908 - DNA, 6887 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccacggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgcgttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367909 - DNA, 6796 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccacggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgcgttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367910 - DNA, 6763 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccacggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367911 - DNA, 7915 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgaggttcagatggtgtcatctcagtagccacacatggttggatcatgtatttagaccccccacctgtgttcctcaatcacactgaagccacagctgggcccaccgaggtgctatcctgcccaggccagcacttggctgagttgggttggagtacacacctggtgtgcagggtgaagcagctcattttgtctggtcctgatcccagactcaccccatctgcagcaagacccttggctggcttcctccgctctgggtgtctcccacatgtctactatggcaaaaaacattaccatccccacccataccacagcatcccctagagagagtgaggtgcagggacccgagggccaggttagcacagcgctggccccagcatggagggaagccctgtgggccacggtaggctagaagggaattcgagctgggcatgaaaaggatgctccggggccattgttagtgggtttggggctgaaatgagtgatcctgcctctggtcccagcatccagctgcctcgttgtctatcctgggagggtgtggtgcttcggacacgttgaggggctttgtcagcatcaggaaggcctttgcttcttgcacccaggcccagctgagacaggcccctgagtcctggctcatgttctggcagcaaacttcacttttcctaaggaagggaagaaggaggcagcagggaagcaaccctgggttttcagaaggtccttctgatggctaggctaaggggaggaagaattcctgccatgccccagccttctccaggacaacctgctggaacgcagtggtgttttcagggcactgtgtttgccttgcagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtgagctcttccggcctggggtgggggccgcagccactgctccctcctgggtagcatgctgcctactcagcccagggatcagctgtgatcagacttgggctcagtaggtggaaagggagattccacggaagaggcatcgcctgcaggactttgcggtgggacccctgaaactggacctgcatagctacgtgaggcctgcacagtgagtcagctggggtgccccatctcctttcatccccatggggtgcaccctcaccaggcactggtggagccaggcagggttctcagagcaaaaggacgggcatgggtggagaagtcagcagaggagcccagggaaaggctggcccgaggctggatgagcagagtgggggcagccagaaggccccaggcgcccggcttgccccaacaatgcctattgctgggcaggctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcacattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataatttggaagcctggcctggtggcatctacttgtagtcccagctattcagcaggctgaggcaagaggatcacttgtgcctaggagttcaagaccagcctaggcaatatagcaagaccccatcttagaaaaaaacttttttaaaagattgatttaaaagatatttacatttttaggccaggtgtggtggctcaaacctgtaatcccaacactttgggaggccgaggcgggaggatcacgaggtcaggagttcaagaccagcctcgccaacatggtgaaaccctgtctccaccaaaaatacaaaaattagctgggtgtggtggcagacacctataatcccagatactcgggaggctgaggctgaggcaggaaaattgcttgaacccaaaaggcagaggttgcagtgagccgagatcacaccactgcactccagccagcctggacaacggagtgagattccatgtc

SEQ ID NO: 367912 - DNA, 448 bp, Homo sapiens
ctgagggtggctgcctcctctggtccccaggcccctccagttcatcggaattcagccatgaaactgactcatcagtgagcaggggtggaggggcggggcaggctggccactgagggccactgaggtgtggccagtaggctagttgaacctcagtgactgcgtgaacctcagtgattccttggtgacaggttgagggcagctccagtgccagcaatagggtggcacagaagctcatctcagtcatcctgcaggcacatgagggggtgccctccggccacctgtactgtatcagccccaagcaggtggtgagttggggtatgggctgggagctgtctgcattggccggccagtgggcatgggacagtgctaaggctgctgtgtctatgccaggtggtccctgctgggggcagcagtaccatctacatctccttcacccctatggtgctca

SEQ ID NO: 367913 - DNA, 502 bp, Homo sapiens
gaaaatgggcaaaaaatgtgaataaataccagaggaagaaatttgaaaggccaaacaagatataaaagagtctcaacatcactagtaaacatggaaatgcaaattgaaacaataatgagatggctcattacaccaatccgattggcaaaattagtgtctaacgggagtattgatgaagatatgggggaaataccaatgtctgtaaactgatgggaatttaaatttgcacaactactttggagagcaatttgaaaatgcttgataaactttaagacgagcaaatctaggatccagccaactttgccactgatgtgtgattcttaggttaagtttcctaattggggcctgagtcagggattcttgtgcagtgatttattgaagcagaactcttaggtgaaagggagatgggatggcagatagggtggaagcgctaggcagtgatatgttcttggttgaagattagcttcaatctgatcccatgggagctctggggcatgagtga

SEQ ID NO: 367914 - DNA, 6781 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacggaagaagagaagaataaaaaatattagttttaaaagtggcctatgtgactgcttttctaaaaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccattttt

SEQ ID NO: 367915 - DNA, 10905 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367916 - DNA, 11450 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacggaagaagagaagaataaaaaatattagttttaaaagtggcctatgtgactgcttttctaaaaaggtatttaatgctcttagtactttggcttatctctttgaaataaagctaatacacaggattgccttcacattgttgtactcttcctttcttgattgataattgcattgtcttagagcctagaaattgttaatattagctaaaactacttggctgctctattagaagttccctttttgtcaaatttttctcaaacatgtttctgcctcacaaggagccccaggtattcatgaggtaatggagtacctaagaggcctaattttgtggacacactatggtgaaatataattttggggtattaacttctcagcttctttctttaaaaaataaccccataagaagtcattgcctatctagacatcccagttgtttgctattgtttaagccaagaaagctctttggtttgcttttattctaggcttaatgtttatgtaacctaaacattccccaatcttgtttcctacaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367917 - DNA, 10135 bp, Homo sapiens
caattcagatagtggactgaactctagaagattaaataatattgttccatctctcttaaaacatcccatgtaataagacttactaaatacattgtaataataatatttcctttttaagaattaagtactttatttttgttactcttgtaattatagtattggctgtcaacagtcttagaaattagtccctaatttgggagttcctccaagtaatacctgcaggttgtatgtagtacgtactgcatacacatacaacattaatgggtaagctctctggatcttacgtgactggattagaatcttaaatttgccttgctgtatgattttgagcaagttactaactttgctgtacctcaggttcttcatcttcagtgagagataataaatagtatatctacctctagataaacagttgtaagattttaactaatttaaataattttaaatagtgtctggtccatagtaagctctcaacattggtttttactattattgtgtaactttttatttcaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367918 - DNA, 8309 bp, Homo sapiens
cacaccacctgagtccacaccacctgagtccccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367919 - DNA, 10979 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttcaccccttctcacttgtatgttctgtaaagtgtatttctactttggtaggaagaaagacttgatttaatatttca

SEQ ID NO: 367920 - DNA, 7513 bp, Homo sapiens
ggaagttatattaattcaagagatggaattacattcaaagaataatatttaataaaagaactaacactaaactttgtaaggtctttcaacagtatattgccaaaccccataagagaactcaaattgtgagaatctactttggtttttcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367921 - DNA, 6144 bp, Homo sapiens
agacgtatttggtcaagctgttctagagtatcccagttaatccggaaatcgagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367922 - DNA, 6346 bp, Homo sapiens
  misc_feature (12)..(12): n is a, c, g, or t
  misc_feature (19)..(19): n is a, c, g, or t
agttcgacggangactctncaaaaatcgctttctatacaccctttcttgtgaagcttctggaacacacactctttcaaccaagaaagaagtatgagatccagaaaagagtttccaaaacagagaaggataaagataacaataaaaagaaaagtgtacgatgcttagagagaaccaatataaaattaagtgcagacaaatcaaaggagctgaataaactggccaagaaactagcaaaagaagaagagagaaagaaaaagaaggagaaggctgctgcagccaaagttgaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367923 - DNA, 6123 bp, Homo sapiens
ccaacagaaactatacccactaaacaaatctccatttcttcttcccttcagcctctggtaacctctgttcgactttctgtctctccgaatgtgtctattctaggtacctcatataagagagtaatactgttttttaactgtcttgctttaaaattgttcctaaatttatatttttgaaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367924 - DNA, 7369 bp, Homo sapiens
tggtctctgattagtttgctacaataggaacattttggtgagtttttttattgcacagacttcagaagctaaacaatcaattacagaacaaaaatcagtttaggaaggtattgttaagttgctctgaatttacaggaagtgatatcacagagggccagcaatgatcggatttagaatatatgagaatcacttgggagctgattaaaaatgtaagcttctggcttgtactccccagatattctgagttcatagggtgatgggtcccagctacattttaaacaaacacaatagatgattctgatgccagtggtctacacactttgaaaagcagtgctgccgacagttgtatcaaggtgcagaacgttttgtgtagtgtagggtaatgagtagagccatgagaccatgactggaaagtgcctccagtatcctgggcagtgaattaggtgttttgccatacattatttcattggatcctctcggtaatcttgtaattaatgtcatctccattttcagatgaggaaattgagtcactcaggttaaatgacttgcctgaaatgatacacactggaactcagagcttctgagttgagtaatcttgatgttaacacaatattgtctcttaagatctagaactttagcataggaacaaaacaagtagaatatcattttgacaaattatttttcccaccccttattacaagcctaaaactactgacgtgactactgtggttttgacagttttttataggacatggaaactaattttgaaaactactcagttgctatgaatgaaactcatttacctagccaaaacctccttcatctgttctttctcttaagttgtatagaggtacttcttggatccctttctattccttactttgatatctggtaaagctcatggttttaagtggcttcttaacgttaccaatgaaatgaccaaccttggtattgaggtgaggaagagtagctcttttcatcttaaatgttcttgtctgccatgacattagctgtaaaaactaccacaatcagccttcaaatataaaagccaaaagtcactttattgttaactcttaagtccaaggcttaaagtcaccaaactacaatcccttcctagcctcctgtaatcacagtattgtcagaagggtcaaagtttgacacctgccactgacctatcagtttttcagattttaattttaaaccccagagtgatctattgacctgtgtctttgactgttataattggttaatttgtaagatttgacatctgatatttgctaactttttatagggagttgtatttgtaacggaagaagagaagaataaaaaatattagttttaaaagtggcctatgtgactgcttttctaaaaaggtatttaatgctcttagtactttggcttatctctttgaaataaagctaatacacaggattgccttcacattgttgtactcttcctttcttgattgataattgcattgtcttagagcctagaaattgttaatattagctaaaactacttggctgctctattagaagttccctttttgtcaaatttttctcaaacatgtttctgcctcacaaggagccccaggtattcatgaggtaatggagtacctaagaggcctaattttgtggacacactatggtgaaatataattttggggtattaacttctcagcttctttctttaaaaaataaccccataagaagtcattgcctatctagacatcccagttgtttgctattgtttaagccaagaaagctctttggtttgcttttattctaggcttaatgtttatgtaacctaaacattccccaatcttgtttcctacaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttc

SEQ ID NO: 367925 - DNA, 6214 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtgagttccaactgtttatagtcaagcatgagaggtcaaggagcaacagttgtggagacacatgtttgatatcaatgtgtagtatgtttttggttctaggatttggacttccaacataatgtcttttgtacaatttctataaactgttttgaataatgaggctcttagtgtgcctagtagaagtgttgtatttcaaaaatcatatacttaatgaacataatgagacaggagcagagagaagctatgtgacattccctggcaaacagtgcatttcatatgcagtgggcataacaagtttcagaataatcttgtgccttccctataaggtgactcagagaactaaataccttgtcggatagtcacaatggcctgaaaaaaatcctgggccagtattgtaagagctgtggcaaattgcattaagatggtattccaaagacttgaaacttttagtccatatcttacactcagagctgtgggcaccctcctaaatggaatatgattttcttcaaatcttttgcaacaaataattcaaacctataaatgcattattttaggccaggcaaggtgtggctcacgcctgtaatcccagcactttgggaggccgaggtgggcggatcacctgaggtgaggagttcgagaccagcctagccaacatggtaaaaccccatctctactaaaaatacaaaaaatgagcagggtgtggtggcggacacctgtaatctcagctacttgggaggttgtggcaggggaatcgcttgaacccaggaggcagaggttggagtaagccaggatggctccattgtgctccagcctgggccacaagagcaaaactctgtctcaaa

SEQ ID NO: 367926 - DNA, 4885 bp, Homo sapiens
  misc_feature (4770)..(4771): n is a, c, g, or t
  misc_feature (4775)..(4775): n is a, c, g, or t
  misc_feature (4861)..(4861): n is a, c, g, or t
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaagtctagcaacccaaggaaacaactcggaaanncctnggtgccaagttgaacccgggggtggccggacaggcacggaaattaggggggcccgggttttcggactactcttggttgtggccccnctggaaattttttgggggggaccc

SEQ ID NO: 367927 - DNA, 2578 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgagtcttttggtgtcttccttcagttgtttgtttgtttgtttgttttttcttttttctttttttttgaaacagggtcttgctctgttgcccaggctggagtgcagcggcacgatgattgctcattgcagcctcagcctgctcagctcaagcagttctcctgcctcagcctaatgagtagctgggactataggagcacaccaccacccccggctaattgttgtattttttgtagagacgaagccttattgtgttgcccaggttggtctcgaactcctgagctcaagcagtcttcccaactcggcctcccaaagtgttgggattacaggtgtgagccactgcacccagccagtatttttaatttaaagttattttagcttttgattagatagaatcacaacatatgctttgttttgtaa

SEQ ID NO: 367928 - DNA, 1164 bp, Homo sapiens
gatttaaagtcttctgtgtttagcagtcgtaaaacattaatgattttgcttcagactcggttaatggaacataaacagatctttgacacttctttgtgagggagaaaatgctagagagggtggcttggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttcaccccttctcacttgtatgttctgtaaagtgtatttctactttggtaggaagaaagacttgatttaatatttca

SEQ ID NO: 367929 - DNA, 368 bp, Homo sapiens
atgttttctctctgctctcacatgttcctgtaatcctgagcggcttgtatgtctctaccatccaactgatctgtgcccctgccccatgcagaagaaatgtcttaggtatccaaaagtattttgtaaaacttccattacctttttttaaaaccaagttttaatgttatttttacttattcccttactttactcctttactctggacttctaaacttcactgtctacttctaggcttgaagaccagtcccttaaagttggccctaaacctggcagctgaaattagtttatcagttgatttcacatgttccttgtctccctgaattaagaagtgtgggctggtttgattttctctttatgtgaactaagat

SEQ ID NO: 367930 - DNA, 10141 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagcca

SEQ ID NO: 367931 - DNA, 3087 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacaggtaaacctaagaagagtttaattctccagtgttttcctgtttctttcagagtaaaaaccaaaattttatccggcctgtgaagccgtacattatctttgacctcttgttgccatgtctcttgcttccccagtaatgctccagttttatctcctact

SEQ ID NO: 367932 - DNA, 2224 bp, Homo sapiens
ccacaacccagcaaagaacataggctaggtacgaggccttcgtgttaattcggccgaggctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcggctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggaccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactgaggtcccgggtttgcctacctgggcgtatgagcgagactccatctccaaaaaaaaaacccaaaaaacagtgcttgttgttcttttgttgttattgttaaaggatcattatctcattatcaacaacattggcaggtaattgagcaactgtttgtctccttgtcatgtggagatagaaaatggcctacgaggttgacaggtgctggagcagcgtcaggaagagagacgac

SEQ ID NO: 367933 - DNA, 1354 bp, Homo sapiens
gcggccgcccgcgagcggggcggtgccacgtacggctccggaagaagcgacggaatctgctagggcacaagagagacgggcgctcgcgctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggaggagctgaggggcaaggaggatgacaagatctatcggggaatcaacaattatcagaaatacatgaagcccaaggatacgtctatgggcaatgcctcttccgggatggtgaggaagggccccatccgagcgcccgagcatctacgtgccaccgtgcgctgggattaccagcccgacatctgtaaggactacaaagagactggcttctgcggcttcggagacagctgcaaattcctccatgaccgttcagattacaagcatgggtggcagatcgaacgtgagcttgatgagggtcgctatggtgtctatgaggatgaaaactatgaagtgggaagcgatgatgaggaaataccattcaagtgtttcatctgtcgccagagcttccaaaacccagttgtcaccaagtgcaggcattatttctgcgagagctgtgcactgcagcatttccgcaccaccccgcgctgctatgtctgtgaccagcagaccaatggcgtcttcaatccagcgaaagaattgattgctaaactagagaagcatcgagctacaggagagggtggtgcttccgacttgccagaagaccccgatgaggatgcaattcccattacttaggtttcccataattcttaaatttaaaaaataaacgttttgttcttttggaagtcttacttcgtgtccttcctttgtagagaaagtgacagagcaggcgggtggtgaag

SEQ ID NO: 367934 - DNA, 1222 bp, Homo sapiens
  misc_feature (1193)..(1193): n is a, c, g, or t
  misc_feature (1195)..(1195): n is a, c, g, or t
gcggccgcccgcgagcggggcggtgccacgtacggctccggaagaagcgacggaatctgctagggcacaagagagacgggcgctcgcgctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggaggagctgaggggcaaggaggatgacaagatctatcggggaatcaacaattatcagaaatacatgaagcccaaggatacgtctatgggcaatgcctcttccgggatggtgaggaagggccccatccgagcgcccgagcatctacgtgccaccgtgcgctgggattaccagcccgacatctgtaaggactacaaagagactggcttctgcggcttcggagacagctgcaaattcctccatgaccgttcagattacaagcatgggtggcagatcgaacgtgagcttgatgagggtcgctatggtgtctatgaggatgaaaactatgaagtgggaagcgatgatgaggaaataccattcaagtgtttcatctgtcgccagagcttccaaaacccagttgtcaccaagtgcaggcattatttctgcgagagctgtgcactgcagcatttccgcaccaccccgcgctgctatgtctgtgaccagcagaccaatggcgtcttcaatccagcgaaagaattgattgctaaactagagaagcatcgagctacaggagagcancngcagtagggtatactctagatctgacc

SEQ ID NO: 367935 - DNA, 1300 bp, Homo sapiens
gcggccgcccgcgagcggggcggtgccacgtacggctccggaagaagcgacggaatctgctagggcacaagagagacgggcgctcgcgctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggaggagctgaggggcaaggaggatgacaagatctatcggggaatcaacaattatcagaaatacatgaagcccaaggatacgtctatgggcaatgcctcttccgggatggtgaggaagggccccatccgagcgcccgagcatctacgtgccaccgtgcgctgggattaccagcccgacatctgtaaggactacaaagagactggcttctgcggcttcggagacagctgcaaattcctccatgaccgttcagattacaagcatgggtggcagatcgaacgtgagcttgatgagggtcgctatggtgtctatgaggatgaaaactatgaagtgggaagcgatgatgaggaaataccattcaagtgtttcatctgtcgccagagcttccaaaacccagttgtcaccaagtgcaggcattatttctgcgagagctgtgcactgcagcatttccgcaccaccccgcgctgctatgtctgtgaccagcagaccaatggcgtcttcaatccagcgaaagaattgattgctaaactagagaagcatcgagctacaggagagggtggtgcttccgacttgccagaagaccccgatgaggatgcaattcccattacttaggtttcccataattcttaaatttaaaaaataaacgttttgttcttttggaagtc

SEQ ID NO: 367936 - DNA, 725 bp, Homo sapiens
gcggccgcccgcgagcggggcggtgccacgtacggctccggaagaagcgacggaatctgctagggcacaagagagacgggcgctcgcgctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggcaggtttgtccagtcagaaccagtcaaggattccaggctgtatacatcataatacatgctaatacgaatgttactgagtttacact

SEQ ID NO: 367937 - DNA, 1139 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctg

SEQ ID NO: 367938 - DNA, 543 bp, Homo sapiens
  misc_feature (8)..(8): n is a, c, g, or t
  misc_feature (14)..(14): n is a, c, g, or t
  misc_feature (43)..(43): n is a, c, g, or t
cgacaagntgagtnagcccgcggcgatgtaccgcttgcgacgngcgctaatgactgctggcatgatctcagcatgtgcggctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctg

SEQ ID NO: 367939 - DNA, 522 bp, Homo sapiens
  misc_feature (11)..(11): n is a, c, g, or t
cgccccgcgangaaccggctgagaccgacgcggataatgactgtggcatgacagcatgtcggctatgttaactgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctg

SEQ ID NO: 367940 - DNA, 1196 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaaattcactttctactttatcttcattgtggccccctttgccgttgattt

SEQ ID NO: 367941 - DNA, 1355 bp, Homo sapiens
  misc_feature (1142)..(1142): n is a, c, g, or t
  misc_feature (1150)..(1150): n is a, c, g, or t
  misc_feature (1162)..(1162): n is a, c, g, or t
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgtancaaaaaanacaaagagcaanaaagcagttgggggggggccgccggaaaagtttttaaaacattcgttggggcggcgggcccaagtgttatgaacttggccaagggctccaaggacccggcaaggaatggggggttccccaaaaaacgcggggaccgggtttgacaaccaaggggtggggcaggcttcacgggcgacaaccccgcgacgcaggg

SEQ ID NO: 367942 - DNA, 1277 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgacacaagcgtctgagatgttagtgttagttagttttgttgtgagtgttaggaaaagggcatacaggactaggaagcagataaggaaaatgattatgagggcgtgatcatgaaaggtgataagctcttctatgataggggaagtagcgtcttggtagacccttttcctactcg

SEQ ID NO: 367943 - DNA, 125 bp, Homo sapiens
ctgcccacccacttacctttccctagcctgaagtggtgtgcttgggtcgctgtctactgctccttcatcagctttgccaactctcggagctcggaggacacgaagcaaatgatgagtagcttcat

SEQ ID NO: 367944 - DNA, 1327 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaagaaaaaaaaacacaaacttttgggcgcccgggcccgaaaaagatttaaacaatcggtgggcggccccgggatatgacacggcaaccgtgtccagagcaccggcgacaggtgggttcccaaaaagccgggacgcggtcacaccagggtcgggcttcgggctcaaggcagctaccccgccg

SEQ ID NO: 367945 - DNA, 1033 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctg

SEQ ID NO: 367946 - DNA, 1202 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaaaaaggccgcgttttcaacgtctgactggaaaccctgccgttcccaactaatcgg

SEQ ID NO: 367947 - DNA, 1639 bp, Homo sapiens
  misc_feature (1161)..(1161): n is a, c, g, or t
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaaacaaaacaacaanacaacaaaaaaaacactcatcaaaataaaaaaacaacaatactaatcaccaaaactcacaactaaccatcacatctactcatccctcaataagactgagccgctcgacctctacccacaccaaaacacaccaccccccactcaacctacctacccagactcacaccagacacccgccgacacccatcaacaacccacttcctcatccctacaccattctctcctctccccactcctacttacaacatctcaccaccatacctacactcctgcctcctcactctcccatcttgtagtacacattcaaacacaaacagtcacacaacacacaatacctccacaacaacacactaaaagacaaaaacaaactcccctcacccatccactaccattcacaaacacacgaaccttacccatgtcttattcatcctcacactcactacaacatctccacaccaacacagataccactaataact

SEQ ID NO: 367948 - DNA, 1233 bp, Homo sapiens
ggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctg

SEQ ID NO: 367949 - DNA, 636 bp, Homo sapiens
tagaggaatgagtgtccaggcagagttcagaaggtaggaatgtccctcttgatagggctgaatcaagggattcctggctttagaaagggtctgctatctttgcaaaaatgtgcaagtatctgtagccagtgtaatgaaatcacttccaaatccagcctgttacctgacttttgtcattgttttcccaaaaatttgaggtatcattgaaacaggtcattttaaacaaatctattacggattctcagggttggaaataattcgatgattgcttagtcctcccccacccctagaacaccccagcacatctgaagatgagcgcctctccctgggtacctgcaagtgatcaccttggcctgcttgcataccttggctgataggaagcgcgccatccccaaggcagctcctgctgtggttggacagtgctgactgttagacagttcttccctatattgagccaaaatctgtcctgccacttgctggatcttggttgcagaccttcccattcacccagttatatatctttgctttcaaaatagtcaccttgagagaccagacatttttctgaaaacatcattactcagaattcagattcccctctgggatctgtcttcagaatcaaagttagctcttttctat

SEQ ID NO: 367950 - DNA, 290 bp, Homo sapiens
gcgtaattcaggaaagaactgtctaacagtcagcactgtccatccccaaggcagctcctgctgtggttggacagtgctgactgttagacagttcttccctatattgagccaaaatctgtcctgccacttgctggatcttggttgcagaccttcccattcacccagttatatatctttgctttcaaaatagtcaccttgagagaccagacatttttctgaaaacatcattactcagaattcagattcccctctgggatctgtcttcagaatcaaagttagctcttttctat

SEQ ID NO: 367951 - DNA, 643 bp, Homo sapiens
atacagacaactctgccacaagcccagccttcttaggaatttgtgtttatctcagtggtttctggttttctcttgtgtgtgagggctggaacacctcttatgaatggtccacggctttcactccttccattgataatgtttgctgcgaatgttttggtgaaatctttcaagaaccatggccatcccccttcttttaaagccaaaacagcaccagtgcctggcacgggttatgcagacggttggcatcatcccctgctaggatttactattatttggaaattaatgatggcttcgtcttttcaggagtggggaggggagctgtgattgacgaaacctctctttgaccatctgtttctttccttcaaggcactgcttttcacagccttaaaatttgagagaaattatgctaagtgatcacaaattttctttaaagttttacttcaaaggaaaacaaaagaaagcctttcaaaaagacgactagctctttttctggaggtcaatataccacagattataagccagaaaaaaaaaaaaaaggtaaaatgagatttttgcttggatttgtttttaattaagacctaaatcatgattctcttagaatggaatagaaagtgacagtagctctgagacctacttgatcaat

SEQ ID NO: 367952 - DNA, 439 bp, Homo sapiens
gcattgttttcgtcgttatctgtagaactgtcagtgagagactgacaaagacattgacacctgactgtaggctttattccaataatgttcagccaagtagggccccactagctgaaatcatgagaattaatgcatctctctggtgataggtctaacacaatttaggcttttttaaaacatgtcagttttatgtggtattactgaatttgcctcccagtgccctggtgcgaagattcttagctagaaggacaattggagtttacatttgaagatcaaattaccatttaactcttaggcaataatccattgtacttttgtcctgagttaaaattacagtgcttcagcagttataagctgtcctattttctctgcttttaaacacaagctttgtaacttaaaatatctgtttgtccttttgatcaaaatcatcacatatctc

SEQ ID NO: 367953 - DNA, 257 bp, Homo sapiens
aaaaatgttgacattttgatgcaaagtaagattcaatatgcttaatatgttaatattttaatgtaccaattctgatatctacaatattattttataggacaaccacacacttgtaagtaaagcttttatagaaagaaatgatttctgaatttcatcatcatatcaatcatcagcactgaccggctcagactaagtttcagcattaatgtagaaaacatagcatttgtacccatggtgcaagccgtgaggcctctgcc

SEQ ID NO: 367954 - DNA, 293 bp, Homo sapiens
ctttgaaatagaaatggagattttaacagatgaccacttacaatcaatttggtgacagagacattaactttgaactcccaattaagaaaaatgtcctctctccaaaacctgactcatagtgtaaaaaatgcactttgttggccaggcacggcggctcatgcttgtaatcccagcactttgggaggctgaggcgggcagatcatgaggtcaggagttcaagaccaacctggccaacaaggtgaaaccctatctctaatatgaatacaaaaattagccggtcctggtggcgtgtg

SEQ ID NO: 367955 - DNA, 376 bp, Homo sapiens
gtctgtaatttagctactagggaggctgaggcaggagaattgcttgaacccaggaggtggaagttgcagtgagccaggatcacgtcaccgcactccagcctgagcgacagagtgagactctgtctccaaaaacaacaacaacaacaacaacaacaaaacaaaaagaaattacgatacaatatggaagtattaaagagattacaatatgatgaagtaccaaatgagtggttctgagaagaaaaactgagcatgggctggtgttgtcaggaagacttcattgcagaagaagggcttgagctgggtcagttcataagcactttttatattcatttccaaatattttattattatatttataagcatgtgaaaaacatta

SEQ ID NO: 367956 - DNA, 527 bp, Homo sapiens
attttatctgagaccctgactctaaccctgtgccatggaaaaacaaacaaacaaacaaaaaactagcatggtgagagggggcagggttgaagacacagtaacatgtggctctcagaaggtggcatccccttctgcagtggcagtgtcacccctcccagcccggcccaggggcctggtgcacccaaagaggagcccgacattttctcagccagaatgaatcacaggcacattctgctgcggttctgagaggcatctggccagtgttatagacttttcatgtgtcctgttggttgtgatcctcacagcagcccttggagatgggctgaacatgagagacaaggaacaagagtacaaggagataagaagctcaaaaaacaacaaacaaaacccaaagctagcagaaggaaaggaacagtaatgattagagcagagataaacaaaaagagaattttaaacaacagagaaaatcagttaaaccaagagttggctgtttgagaagactaacaaaattgacagacctttaactt

SEQ ID NO: 367957 - DNA, 478 bp, Homo sapiens
gccattatgtggaatatttgtgagtaaactagtttttaccgtgaaattgtagaaagtactaaatcagaacttttgcttttttccatttgtgagcttgagccactcatttcatctcttttgtcctcttgttcttgatctataaaatcagaagattggatcaggttatctcttagagttccttgaaactccaaatgttcttatttttttacgtaggaattactggattgaataatggggttagaactgtgtgtatatatgtatatatctttgaaaactgggggtaaatcttttttcttttttgtttttggttttggtaaatttattattataagaacttagatcaggcggagtgcggtggctcacgcctgtaatcccgacactttgggaggccgaggtgggtggatcacctgaggtcggagcttgagaccagcctgaggaacatgaagaaaccctgtctctactaaaaatacaaatttag

SEQ ID NO: 367958 - DNA, 468 bp, Homo sapiens
ctaatgttttgtatttttagcagagacggggttactccgtgttagccaggatggtctcgatctcctgacctcgtgatccacctgccttggcctcccaaagtgctgggattctgtaatcccagtgagccaccgcgcctggcccatcagatgcttcaggtgactacagccagctccagaggttccaaagatcttaaagatgtcccagaaaagttctagagtactatcagatctcacactttgccttggaagctgtcattcccctccattggccccacaactgcagtataatcttcagtgacaggagaaaatcgaccttgtttgtacagaagtctcagcaggaataggcagatgcctgtttttgctgccaaggatggaggattggaatgggcccattatatattttgaggctttgaagaaaagtctcaggatatgttttcccattaaaatactgttataaacaattagatt

SEQ ID NO: 367959 - DNA, 595 bp, Homo sapiens
tgtgtgagacatggttctaaggaaacaataatgaataaaacaaagttcctgcctttatggagctcggcttttagcaggaagactaaagagaaccaatggtttcaactgggcgtacttttgcaccccatccttggaacatttggcaatgtctggagacattttttatcatggactagggaagaaggagaggagggagattctattggcatctaatctgcagaggccagagatgctgctgaccatctctacaatgcacaagacaggtccccacaactatgaattatctatccaaaccaaaatatcagtagtgggctaggtgtggtggctcacacctgcaatcccagcactttgggaggcggaggaaggcagattgcttgagcccaggagttcaagaccagcctgaacaatatggccaaatcctgtctttacaaaaaaatttaaaaaattagccaggtgtggtagcacatgcttgtagtcccaactactcgggatgctaaggcggaaggatagcatgagcctggaaggtagacgctacagtgagctgtgatcacaccaccactgcactctagcctgggtgacggtgagaccctgtctc

SEQ ID NO: 367960 - DNA, 461 bp, Homo sapiens
tattaaaagataattcactatttaaagataacaacttttcatgatgcttataacattatgaccacaatagcacaaaagatggaagggtaaatagaagcatgttgttgtaagatcttatacaagaagtggtgtaatattgtctgaatgtaggctgtggtagggtaaatatgcatatgcaaaacaagaagcaacagaacaaaacatgtccaaataagtgcagtaaaaaacctcaaataacaggaggtaaaatggaatactgaaaaagcaatcaaataattcaaaagaagtcaggaaaaagaaaaaaaggaacaatgaagaacaacaacaaaaaaagaaaaaatggaggctgggcaccagtggctcacacctgtaatcccagcactatgggaggctgaggtgggtggatcacctgaagtcaggagttcaagaccagtctggccaacatggtgaaaccccatctc

SEQ ID NO: 367961 - DNA, 2643 bp, Homo sapiens
  misc_feature (1)..(1): n is a, c, g, or t
  misc_feature (601)..(601): n is a, c, g, or t
  misc_feature (638)..(638): n is a, c, g, or t
naaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagcnagcaggccgccgctccgcgagtcacgtgactggaagnagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367962 - DNA, 1002 bp, Homo sapiens
attcagtgcttgcagagctagtgttactaatataaccttgtaaagtgcagaattacattggcaattttggttgcatatcataaaagattaggttagggggaaaagggtgctttctagcttttttatactgaagcaaaacaacacactattcattaagataccaaaatgtgtattttcagcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367963 - DNA, 5887 bp, Homo sapiens
  misc_feature (1)..(1): n is a, c, g, or t
  misc_feature (601)..(601): n is a, c, g, or t
  misc_feature (638)..(638): n is a, c, g, or t
  misc_feature (1473)..(1473): n is a, c, g, or t
  misc_feature (1750)..(1750): n is a, c, g, or t
  misc_feature (1841)..(1841): n is a, c, g, or t
  misc_feature (1848)..(1848): n is a, c, g, or t
  misc_feature (1926)..(1926): n is a, c, g, or t
  misc_feature (2813)..(2813): n is a, c, g, or t
naaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagcnagcaggccgccgctccgcgagtcacgtgactggaagnagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagnggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcanaagtctgaattgtgattcccagttcctccaggcctaagggaagagttggagattggccactacatgtcgtctgtttaggtctgaatttagnaatggangctgtcctgaaggctaagctagcccttggactccagatctttctctgaactttttcttaatgcataacaatagatganctgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtactaaaaaaaaaacacaaaaaaacctaaacagacactggttcttactatttagaggaacaaaaaaatcttttgcttctctgctttggtgaacatctgtgtcagaagagcngatcaccaattctaaaatcgtaattattagggatgacctagtgaccatgtttttcaaacttgcctgtatagcagctgtatttgttcagctgtttttttttttaattgctattaaccttatgaacttagtggtaaaagtaaatggtgtgtgtgtctcttatcctgttttaaacttaatggaaagggcatgttgctgtgaacaaatggagtgtatttgtatttgtctcctctaatcattaataattaattttctcttaaaatattgaagcctagaattctggtaaagccaaaagtttatgctgatcattgggacgttttacagtgtgaaaggtggcatttggtctaggtagattgttttgctttgttcagatcaaagtctttctttttagaaatggaacctggtcagaccctgaggcgacataatgagaagccaagaaaggttgagggacctcactagggaagtctcagaaaagcagccattaagatagcaggctttcagaaagaactgagaggaaatcatgatcataacattagctttatgatgtgttatttgaattgcgtacagacagtaggaggagttagctggccatgcaactatttagtaaatagctcttcttgctgcccacatacttgcaataggaagtaattgtaggcagaagccaatagttgtgagtgtcaggaaccatgagtgaggaggaatgatgctacagagagagggtttcagggatccactggatgatagagggcttatttttacttaatgccaaggggttatgtgagtaccatgcacatttataattgacttacaaataaaataattagaaaaatcttcaaacagttggacaaaagacaggcctaatttatagagagttaacacgaagaaacatttactaataaaacaataaatttatatagctaggaaatactgtcatacagatattttaaatgacacttttaaatgacactacccagtgctgcccagttgcattaaaatggacatatcccacattgtagtgtatactggtacagctctttggaaaaataattagccctaaatatcaaaagccataaaattgttcataccttttgattcagtaatgtcatttgtgaaattttatcctaaggaaataattcaaaagaagaactacgtgggggggaaatgtttattgaagtattacttataatagtaaaaaacaggaaacaagtcttaagttgaagagtaggtaagtaaaatatgttttattacaaattagaacacagtaatatctgtacattaaaatacatgcatgggggccaggtgcggtggctcatgcctgtaatcccagcactttgggaggctgaggcaggtggctcacctgaggtcaggagtttgataccagcctgggcaacatggtgaaaccctgtctcttctaaaaatacaaaatattagcccggtgtggtggcgcacccctgtaatcccagctcctccacaggctgaggcatgagaattgcttgaacctgggaggtagaggttgcagtgagccaagattgcaccactgcactccagcctgggtgacagagcaagactctgtctctaaataaataaataaataaaatacaagcatgaggattttacagtgaaaatacttggtttaagttgctgagattatggatgatttattgtaccctcttaaaatggactttgttttttaacataaatattaagggcaattaaatcatttgtttactgaatggatgtggtttgctgccaggtctggctttgaactggtgattgttatacttgtttttagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367964 - DNA, 1428 bp, Homo sapiens
aaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367965 - DNA, 5438 bp, Homo sapiens
  misc_feature (1)..(1): n is a, c, g, or t
  misc_feature (601)..(601): n is a, c, g, or t
  misc_feature (638)..(638): n is a, c, g, or t
  misc_feature (1473)..(1473): n is a, c, g, or t
  misc_feature (1750)..(1750): n is a, c, g, or t
  misc_feature (1841)..(1841): n is a, c, g, or t
  misc_feature (1848)..(1848): n is a, c, g, or t
  misc_feature (1926)..(1926): n is a, c, g, or t
  misc_feature (2813)..(2813): n is a, c, g, or t
naaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagcnagcaggccgccgctccgcgagtcacgtgactggaagnagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagnggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcanaagtctgaattgtgattcccagttcctccaggcctaagggaagagttggagattggccactacatgtcgtctgtttaggtctgaatttagnaatggangctgtcctgaaggctaagctagcccttggactccagatctttctctgaactttttcttaatgcataacaatagatganctgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtactaaaaaaaaaacacaaaaaaacctaaacagacactggttcttactatttagaggaacaaaaaaatcttttgcttctctgctttggtgaacatctgtgtcagaagagcngatcaccaattctaaaatcgtaattattagggatgacctagtgaccatgtttttcaaacttgcctgtatagcagctgtatttgttcagctgtttttttttttaattgctattaaccttatgaacttagtggtaaaagtaaatggtgtgtgtgtctcttatcctgttttaaacttaatggaaagggcatgttgctgtgaacaaatggagtgtatttgtatttgtctcctctaatcattaataattaattttctcttaaaatattgaagcctagaattctggtaaagccaaaagtttatgctgatcattgggacgttttacagtgtgaaaggtggcatttggtctaggtagattgttttgctttgttcagatcaaagtctttctttttagaaatggaacctggtcagaccctgaggcgacataatgagaagccaagaaaggttgagggacctcactagggaagtctcagaaaagcagccattaagatagcaggctttcagaaagaactgagaggaaatcatgatcataacattagctttatgatgtgttatttgaattgcgtacagacagtaggaggagttagctggccatgcaactatttagtaaatagctcttcttgctgcccacatacttgcaataggaagtaattgtaggcagaagccaatagttgtgagtgtcaggaaccatgagtgaggaggaatgatgctacagagagagggtttcagggatccactggatgatagagggcttatttttacttaatgccaaggggttatgtgagtaccatgcacatttataattgacttacaaataaaataattagaaaaatcttcaaacagttggacaaaagacaggcctaatttatagagagttaacacgaagaaacatttactaataaaacaataaatttatatagctaggaaatactgtcatacagatattttaaatgacacttttaaatgacactacccagtgctgcccagttgcattaaaatggacatatcccacattgtagtgtatactggtacagctctttggaaaaataattagccctaaatatcaaaagccataaaattgttcataccttttgattcagtaatgtcatttgtgaaattttatcctaaggaaataattcaaaagaagaactacgtgggggggaaatgtttattgaagtattacttataatagtaaaaaacaggaaacaagtcttaagttgaagagtaggtaagtaaaatatgttttattacaaattagaacacagtaatatctgtacattaaaatacatgcatgggggccaggtgcggtggctcatgcctgtaatcccagcactttgggaggctgaggcaggtggctcacctgaggtcaggagtttgataccagcctgggcaacatggtgaaaccctgtctcttctaaaaatacaaaatattagcccggtgtggtggcgcacccctgtaatcccagctcctccacaggctgaggcatgagaattgcttgaacctgggaggtagaggttgcagtgagccaagattgcaccactgcactccagcctgggtgacagagcaagactctgtctctaaataaataaataaataaaatacaagcatgaggattttacagtgaaaatacttggtttaagttgctgagattatggatgatttattgtaccctcttaaaatggactttgttttttaacataaatattaagggcaattaaatcatttgtttactgaatggatgtggtttgctgccaggtctggctttgaactggtgattgttatacttgtttttagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctggaaaaaaaagtcgacgcggccgcgaatttagtaatagtagtcgacccg

SEQ ID NO: 367966 - DNA, 1685 bp, Homo sapiens
gcagagtctcactctgtcacccacgctggagtacagtggcacaatcttggctcactacaatctctgcctcccaggttcaagtgattctcctgcctcagcctccctagtaactgggattacaggtgtgtgccaccacgcccaactaacttttgtaattttagtagagacaaggtttcaccatgttgggcaggctggtctaattaattaagctttttaaacaatttaaccaaaacaaaattctggcattagattcagcatatcaggaggtactctttgaagaccattgcatttctttctttttcagtaaaatgaaggggaaaaaaagtgtgttgacctgaattgatttgatatggggaagaggccttttaagatcaagtcctttctttttgttacaaagttaccttggttgaacatcatattttatttgcattttatgcttttagttattctgtgaacttttctgtacatctggttttgcttagtttgttcatatttatttctcttactagatagtaagttctctgagagcagaaatttgtttactaccccagcacttaacacggaaccttattagttgggttcaataaaaatacattgacaagaatttgagtttttattttatactcctataggactcagaaatagtatcctgatacttaataggcagtggttactcaaaatctgtaccaaaatccaaagggttttaacttaattcgttttctatagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367967 - DNA, 1030 bp, Homo sapiens
caacttaggctaggtacgaggccgggtgttaatctattcgaatctttcctgctagacaagtagtcgaagcaggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367968 - DNA, 5995 bp, Homo sapiens
  misc_feature (1)..(1): n is a, c, g, or t
  misc_feature (601)..(601): n is a, c, g, or t
  misc_feature (638)..(638): n is a, c, g, or t
  misc_feature (1581)..(1581): n is a, c, g, or t
  misc_feature (1858)..(1858): n is a, c, g, or t
  misc_feature (1949)..(1949): n is a, c, g, or t
  misc_feature (1956)..(1956): n is a, c, g, or t
  misc_feature (2034)..(2034): n is a, c, g, or t
  misc_feature (2921)..(2921): n is a, c, g, or t
naaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagcnagcaggccgccgctccgcgagtcacgtgactggaagnagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagnggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcanaagtctgaattgtgattcccagttcctccaggcctaagggaagagttggagattggccactacatgtcgtctgtttaggtctgaatttagnaatggangctgtcctgaaggctaagctagcccttggactccagatctttctctgaactttttcttaatgcataacaatagatganctgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtactaaaaaaaaaacacaaaaaaacctaaacagacactggttcttactatttagaggaacaaaaaaatcttttgcttctctgctttggtgaacatctgtgtcagaagagcngatcaccaattctaaaatcgtaattattagggatgacctagtgaccatgtttttcaaacttgcctgtatagcagctgtatttgttcagctgtttttttttttaattgctattaaccttatgaacttagtggtaaaagtaaatggtgtgtgtgtctcttatcctgttttaaacttaatggaaagggcatgttgctgtgaacaaatggagtgtatttgtatttgtctcctctaatcattaataattaattttctcttaaaatattgaagcctagaattctggtaaagccaaaagtttatgctgatcattgggacgttttacagtgtgaaaggtggcatttggtctaggtagattgttttgctttgttcagatcaaagtctttctttttagaaatggaacctggtcagaccctgaggcgacataatgagaagccaagaaaggttgagggacctcactagggaagtctcagaaaagcagccattaagatagcaggctttcagaaagaactgagaggaaatcatgatcataacattagctttatgatgtgttatttgaattgcgtacagacagtaggaggagttagctggccatgcaactatttagtaaatagctcttcttgctgcccacatacttgcaataggaagtaattgtaggcagaagccaatagttgtgagtgtcaggaaccatgagtgaggaggaatgatgctacagagagagggtttcagggatccactggatgatagagggcttatttttacttaatgccaaggggttatgtgagtaccatgcacatttataattgacttacaaataaaataattagaaaaatcttcaaacagttggacaaaagacaggcctaatttatagagagttaacacgaagaaacatttactaataaaacaataaatttatatagctaggaaatactgtcatacagatattttaaatgacacttttaaatgacactacccagtgctgcccagttgcattaaaatggacatatcccacattgtagtgtatactggtacagctctttggaaaaataattagccctaaatatcaaaagccataaaattgttcataccttttgattcagtaatgtcatttgtgaaattttatcctaaggaaataattcaaaagaagaactacgtgggggggaaatgtttattgaagtattacttataatagtaaaaaacaggaaacaagtcttaagttgaagagtaggtaagtaaaatatgttttattacaaattagaacacagtaatatctgtacattaaaatacatgcatgggggccaggtgcggtggctcatgcctgtaatcccagcactttgggaggctgaggcaggtggctcacctgaggtcaggagtttgataccagcctgggcaacatggtgaaaccctgtctcttctaaaaatacaaaatattagcccggtgtggtggcgcacccctgtaatcccagctcctccacaggctgaggcatgagaattgcttgaacctgggaggtagaggttgcagtgagccaagattgcaccactgcactccagcctgggtgacagagcaagactctgtctctaaataaataaataaataaaatacaagcatgaggattttacagtgaaaatacttggtttaagttgctgagattatggatgatttattgtaccctcttaaaatggactttgttttttaacataaatattaagggcaattaaatcatttgtttactgaatggatgtggtttgctgccaggtctggctttgaactggtgattgttatacttgtttttagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 367969 - DNA, 5448 bp, Homo sapiens
  misc_feature (1)..(1): n is a, c, g, or t
  misc_feature (601)..(601): n is a, c, g, or t
  misc_feature (638)..(638): n is a, c, g, or t
  misc_feature (1473)..(1473): n is a, c, g, or t
  misc_feature (1750)..(1750): n is a, c, g, or t
  misc_feature (1841)..(1841): n is a, c, g, or t
  misc_feature (1848)..(1848): n is a, c, g, or t
  misc_feature (1926)..(1926): n is a, c, g, or t
  misc_feature (2813)..(2813): n is a, c, g, or t
naaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagcnagcaggccgccgctccgcgagtcacgtgactggaagnagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagnggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcanaagtctgaattgtgattcccagttcctccaggcctaagggaagagttggagattggccactacatgtcgtctgtttaggtctgaatttagnaatggangctgtcctgaaggctaagctagcccttggactccagatctttctctgaactttttcttaatgcataacaatagatganctgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtactaaaaaaaaaacacaaaaaaacctaaacagacactggttcttactatttagaggaacaaaaaaatcttttgcttctctgctttggtgaacatctgtgtcagaagagcngatcaccaattctaaaatcgtaattattagggatgacctagtgaccatgtttttcaaacttgcctgtatagcagctgtatttgttcagctgtttttttttttaattgctattaaccttatgaacttagtggtaaaagtaaatggtgtgtgtgtctcttatcctgttttaaacttaatggaaagggcatgttgctgtgaacaaatggagtgtatttgtatttgtctcctctaatcattaataattaattttctcttaaaatattgaagcctagaattctggtaaagccaaaagtttatgctgatcattgggacgttttacagtgtgaaaggtggcatttggtctaggtagattgttttgctttgttcagatcaaagtctttctttttagaaatggaacctggtcagaccctgaggcgacataatgagaagccaagaaaggttgagggacctcactagggaagtctcagaaaagcagccattaagatagcaggctttcagaaagaactgagaggaaatcatgatcataacattagctttatgatgtgttatttgaattgcgtacagacagtaggaggagttagctggccatgcaactatttagtaaatagctcttcttgctgcccacatacttgcaataggaagtaattgtaggcagaagccaatagttgtgagtgtcaggaaccatgagtgaggaggaatgatgctacagagagagggtttcagggatccactggatgatagagggcttatttttacttaatgccaaggggttatgtgagtaccatgcacatttataattgacttacaaataaaataattagaaaaatcttcaaacagttggacaaaagacaggcctaatttatagagagttaacacgaagaaacatttactaataaaacaataaatttatatagctaggaaatactgtcatacagatattttaaatgacacttttaaatgacactacccagtgctgcccagttgcattaaaatggacatatcccacattgtagtgtatactggtacagctctttggaaaaataattagccctaaatatcaaaagccataaaattgttcataccttttgattcagtaatgtcatttgtgaaattttatcctaaggaaataattcaaaagaagaactacgtgggggggaaatgtttattgaagtattacttataatagtaaaaaacaggaaacaagtcttaagttgaagagtaggtaagtaaaatatgttttattacaaattagaacacagtaatatctgtacattaaaatacatgcatgggggccaggtgcggtggctcatgcctgtaatcccagcactttgggaggctgaggcaggtggctcacctgaggtcaggagtttgataccagcctgggcaacatggtgaaaccctgtctcttctaaaaatacaaaatattagcccggtgtggtggcgcacccctgtaatcccagctcctccacaggctgaggcatgagaattgcttgaacctgggaggtagaggttgcagtgagccaagattgcaccactgcactccagcctgggtgacagagcaagactctgtctctaaataaataaataaataaaatacaagcatgaggattttacagtgaaaatacttggtttaagttgctgagattatggatgatttattgtaccctcttaaaatggactttgttttttaacataaatattaagggcaattaaatcatttgtttactgaatggatgtggtttgctgccaggtctggctttgaactggtgattgttatacttgtttttagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctggagcgtaagcggcaagtctccctttgccagtcggggttatgactatatgtgacaataa

SEQ ID NO: 367970 - DNA, 5686 bp, Homo sapiens
  misc_feature (1)..(1): n is a, c, g, or t
  misc_feature (601)..(601): n is a, c, g, or t
  misc_feature (638)..(638): n is a, c, g, or t
  misc_feature (1473)..(1473): n is a, c, g, or t
  misc_feature (1750)..(1750): n is a, c, g, or t
  misc_feature (1841)..(1841): n is a, c, g, or t
  misc_feature (1848)..(1848): n is a, c, g, or t
  misc_feature (1926)..(1926): n is a, c, g, or t
  misc_feature (2813)..(2813): n is a, c, g, or t
naaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagcnagcaggccgccgctccgcgagtcacgtgactggaagnagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagnggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcanaagtctgaattgtgattcccagttcctccaggcctaagggaagagttggagattggccactacatgtcgtctgtttaggtctgaatttagnaatggangctgtcctgaaggctaagctagcccttggactccagatctttctctgaactttttcttaatgcataacaatagatganctgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtactaaaaaaaaaacacaaaaaaacctaaacagacactggttcttactatttagaggaacaaaaaaatcttttgcttctctgctttggtgaacatctgtgtcagaagagcngatcaccaattctaaaatcgtaattattagggatgacctagtgaccatgtttttcaaacttgcctgtatagcagctgtatttgttcagctgtttttttttttaattgctattaaccttatgaacttagtggtaaaagtaaatggtgtgtgtgtctcttatcctgttttaaacttaatggaaagggcatgttgctgtgaacaaatggagtgtatttgtatttgtctcctctaatcattaataattaattttctcttaaaatattgaagcctagaattctggtaaagccaaaagtttatgctgatcattgggacgttttacagtgtgaaaggtggcatttggtctaggtagattgttttgctttgttcagatcaaagtctttctttttagaaatggaacctggtcagaccctgaggcgacataatgagaagccaagaaaggttgagggacctcactagggaagtctcagaaaagcagccattaagatagcaggctttcagaaagaactgagaggaaatcatgatcataacattagctttatgatgtgttatttgaattgcgtacagacagtaggaggagttagctggccatgcaactatttagtaaatagctcttcttgctgcccacatacttgcaataggaagtaattgtaggcagaagccaatagttgtgagtgtcaggaaccatgagtgaggaggaatgatgctacagagagagggtttcagggatccactggatgatagagggcttatttttacttaatgccaaggggttatgtgagtaccatgcacatttataattgacttacaaataaaataattagaaaaatcttcaaacagttggacaaaagacaggcctaatttatagagagttaacacgaagaaacatttactaataaaacaataaatttatatagctaggaaatactgtcatacagatattttaaatgacacttttaaatgacactacccagtgctgcccagttgcattaaaatggacatatcccacattgtagtgtatactggtacagctctttggaaaaataattagccctaaatatcaaaagccataaaattgttcataccttttgattcagtaatgtcatttgtgaaattttatcctaaggaaataattcaaaagaagaactacgtgggggggaaatgtttattgaagtattacttataatagtaaaaaacaggaaacaagtcttaagttgaagagtaggtaagtaaaatatgttttattacaaattagaacacagtaatatctgtacattaaaatacatgcatgggggccaggtgcggtggctcatgcctgtaatcccagcactttgggaggctgaggcaggtggctcacctgaggtcaggagtttgataccagcctgggcaacatggtgaaaccctgtctcttctaaaaatacaaaatattagcccggtgtggtggcgcacccctgtaatcccagctcctccacaggctgaggcatgagaattgcttgaacctgggaggtagaggttgcagtgagccaagattgcaccactgcactccagcctgggtgacagagcaagactctgtctctaaataaataaataaataaaatacaagcatgaggattttacagtgaaaatacttggtttaagttgctgagattatggatgatttattgtaccctcttaaaatggactttgttttttaacataaatattaagggcaattaaatcatttgtttactgaatggatgtggtttgctgccaggtctggctttgaactggtgattgttatacttgtttttagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatcaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggc

SEQ ID NO: 367971 - DNA, 507 bp, Homo sapiens
aattttagctttatttgctgtatcatcatcatcagtatcatcatcatcatcagttttcttgttttaaaatagggtttggagtctcttcaaggctttctgttttggaaaagtaaaacttaaaaatctatagccatgtgaattatacttatggagaaaaagagtcttgttttattaacatcagacatctttgttcctactaattattttggagtaatgttcagtatcgggctaatgatcgatggatatcactcatccaattatgatgcatggattagaccacggccttaaactttgtacatagtgttgaataaattcatcttatttgcagtcttattgtcatctagctttgatacacttgccctttcatatgtctcttgtcactattctgtgtaagattataatcccaaataccactatatgtatttttcttcatattctattattgaacagtattaatgcttaatgttaatatataagtaatatatacattttaaaaattaaaaatgc

SEQ ID NO: 367972 - DNA, 397 bp, Homo sapiens
aaaggacctgtcctcaggggcaagacggtctgggcagagaggctgaggcagaggagtcaggagattcctaggggacagttggactgggggccagactacgccaggctaaggagtgtgatgtgggaagctggagaaggctgtgatgaaatgtgctgtggactttgggaggccgaggcggatggatcacctgaggtcaggagttcaagtccagcctggtcaacatggtgaaaccccgtctctaccaaaaatacaaaattagccaggtgtggtggcacatgcctgtaattccagctactcggaaggctgaggcaggagaacctgggaggtggaggttgcagtgagccaagattgtgctactgcactccagcctgggcaacagaacaaaaactacatctca

SEQ ID NO: 367973 - DNA, 6287 bp, Homo sapiens
  misc_feature (4610)..(4610): n is a, c, g, or t
  misc_feature (4615)..(4615): n is a, c, g, or t
  misc_feature (4812)..(4812): n is a, c, g, or t
actcaagaaacagtttgcgtgcgatgtggacaagagaggtccccgttgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcncattntaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaacngggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccaggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcttctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttca

SEQ ID NO: 367974 - DNA, 6159 bp, Homo sapiens
  misc_feature (4482)..(4482): n is a, c, g, or t
  misc_feature (4487)..(4487): n is a, c, g, or t
  misc_feature (4684)..(4684): n is a, c, g, or t
actcaagaaacagtttgcgtgcgatgtggacaagagaggtccccgttggggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcncattntaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaacngggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccaggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcttctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttca

SEQ ID NO: 367975 - DNA, 6233 bp, Homo sapiens
  misc_feature (4556)..(4556): n is a, c, g, or t
  misc_feature (4561)..(4561): n is a, c, g, or t
  misc_feature (4758)..(4758): n is a, c, g, or t
actcaagaaacagtttgcgtgcgatgtggacaagagaggtccccgttgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcncattntaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaacngggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccaggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcttctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttca

SEQ ID NO: 367976 - DNA, 4460 bp, Homo sapiens
  misc_feature (2783)..(2783): n is a, c, g, or t
  misc_feature (2788)..(2788): n is a, c, g, or t
  misc_feature (2985)..(2985): n is a, c, g, or t
tagcgatcgttatgaggaggagctgagaagtgcatggcagtatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcncattntaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaacngggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccaggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcttctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttca

SEQ ID NO: 367977 - DNA, 3070 bp, Homo sapiens
actcaagaaacagtttgcgtgcgatgtggacaagagaggtccccgttgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccaaaaaaaaaaaaaaaaaaaaaaaaaaatttggggggcgccttgggcctggaaaagtttttaaacccaattggtgggggggggggccccgaggttaggcggaacccggggccaaggcgttgtgcccagaggaaactcgtggccagagaacagaggggcgggttttctccccaccaataaaaaaagcgccgcgggggcaagaccccgaggggccttgtggaaacacactcccgagagtggaggtccggagggcccacagacgggcttctaccacaacgggggtctcccaggcggcagtgcaaatttcaaaatgcgccggcgcgggggaaaagaaacacacaaaaccaaaacgaacaagaaaccagacacacgactacgaccacaaactcaaggaggaagaaagagggaggagcgggggcgagagagacaagaagcaaggacaggacagagagagcacatacaggcaaagacacacgcactaaaacgcacggagaaacatgaggcaaaacaacaaacgacagcagatcgaccgagcgaggagaccgcacacatgagaccagccggccgaacgcccagcaccacgagataacgccacgagcacgcccacgcgagacactgccaagacccagaacccaccacccgcacccgccaacaacaccaccgaccccaaca

SEQ ID NO: 367978 - DNA, 616 bp, Homo sapiens
  misc_feature (42)..(42): n is a, c, g, or t
ctttgtttaatgcttattatcatttattccttacaacaaccntatgaggtaggtactattattcccattttaaagatgtgaaaattctatacagagaggttaagtaacttgcatcaagtcagagagttaataaatgagggagctgattaaaattcaggcgcctggtacccaagttcctgttcttaaccactacaccctagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttca

SEQ ID NO: 367979 - DNA, 467 bp, Homo sapiens
ccgctgagaactgggcacagatgcagatgtttttctaaagccagctctgctctggccatggggtgaaaactctgggaaggaggtgaagttttcttgaaggatggagccagcagcttctggtgatactggtctcggttgtctgggaggtgggcaagggccccctctgtgaccacacattatctttcgccatccagcctgctgccctttacctttgtgggaaacctcttcatggtacctgatgacccactggggcgaaacggccccaccctggatgaatttctgaagaagccagccaggtaatcaatcccctagactacttacaggcagcccccacccctggccctctctcagcaggcccagagacttgggtggaagtgtgacctcagtttgggccagcttaattttgcagtggtttgagttgcattggccttggcctttataagcttcccaggggatcctgacataga

SEQ ID NO: 367980 - DNA, 6232 bp, Homo sapiens
  misc_feature (67)..(67): n is a, c, g, or t
  misc_feature (4555)..(4555): n is a, c, g, or t
  misc_feature (4560)..(4560): n is a, c, g, or t
  misc_feature (4757)..(4757): n is a, c, g, or t
gggagagaaaggagggatgaagccgcctgcccactggacgggagggctgcagccagagcttcagggnagccctgctggatgggacagcactgagggctggacctggggggatggagaacatgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcncattntaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaacngggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccaggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcttctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttca

SEQ ID NO: 367981 - DNA, 6573 bp, Homo sapiens
  misc_feature (4610)..(4610): n is a, c, g, or t
  misc_feature (4615)..(4615): n is a, c, g, or t
  misc_feature (4812)..(4812): n is a, c, g, or t
actcaagaaacagtttgcgtgcgatgtggacaagagaggtccccgttgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcncattntaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaacngggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccaggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcttctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcatcaccttctctggcccttaggatctccccatttggagacagagccatttggatattttccccttgaacttctccatgacctgaagcgttccttccctggaggaactctttggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttcaaatagtggctggtgtgtataattgtttgcaattacttggtcccaaaggtgaccaggaactctgttcctaaagaactatggtgtgagaagtaagggactttgggataggtggacttttccctggcattgagtgatgccactccccactgttttttcagggtctcaatttcttagtgaaagtacacaaaggttaggagaaacatgcatggatcaagggcctaggaagtcattttgcctggaaaagaccagtgctctggtgtgtgcatagctacagaggtctgagttac

SEQ ID NO: 367982 - DNA, 3406 bp, Homo sapiens
actcaagaaacagtttgcgtgcgatgtggacaagagaggtccccgttgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataagaacgacacgtctcggtgttttcttttcttccgttcgtcccgtctttccctggctgtcgttctcgtcggggtcc

SEQ ID NO: 367983 - DNA, 2332 bp, Homo sapiens
actcaagaaacagtttgcgtgcgatgtggacaagagaggtccccgttgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggatttggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggtacttgctcctctcctggccccaggcttgatattgaaggagccctatggaagactgagggagagagaaaagctcctggtggtttacgctgtttctaagccttggtggtgggtaaggggccagttattcctctgtgtgccttatgattgggtaggtaaacctgccctgcaggtgtgatgagatgaactgtagacaaccatgtttgtctattcatcattcatcaaacaaaatgataccttgtatttatatagtgccttactgtctagaaaatactggtttagtggaaaggtgggaaagctggttacataagtagctgacagatgtcttcttataacctgaatttccaaacatgcagagaaatttccctaacattctggaaaaaccagagtaaaggtcaaaataacaagtaaaatggagaaacacaacgcatgaataataggactgtacaaaacatggtataatagaaagatcactggatttagaattggaagatctgaatttgagcctcaagtagcactactcattgactttgactgtggaacttttcttagtgaattaacc

SEQ ID NO: 367984 - DNA, 1610 bp, Homo sapiens
  misc_feature (7)..(7): n is a, c, g, or t
  misc_feature (65)..(65): n is a, c, g, or t
  misc_feature (331)..(331): n is a, c, g, or t
tctctgngagactgctgcaccctcatctgtcaaagatggaactggacttagttgagctctgaggnccctgtggacttggcccctccacaccctcattatggcaactggacataaacttaacagagggcttcccagcaaaatgtcctcttcttcctacaaacaggctgtttctatatgtgcatgtttcatgctaagcacttctttcttgggtggagatggcaaaggcctctttctgctgagacaaagtgatttggagagtcacctggcccctgaagggggagtggtaggatccagccacccagtgtgcagtgaattggagcagggatctcancacacagggaggtggggaggctccccctaacctcgggcacctgttgctcctccagactgcagcgcatgctcttagctcatcctcttaactggctctcaccgtgctcctggctttggtcaccacgtagctctcactccagcttcaggtagccatcagtagggcctggcaatatacactgatttggtttgttttatgtttgtctgcaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367985 - DNA, 1821 bp, Homo sapiens
  misc_feature (1309)..(1309): n is a, c, g, or t
tagtttttgtatttttagtagagatgggtttcaccatgttggtcaggctggtctcgaactcctgacctcatgatccgcccacctcagcctcccaaagtgctgggattacaggtgtgagctaccacgcctggcctattatgatttttaatgaagtttgtcataaccaagtacttgtcattttctgatgagaacactgaaagtttagggcatgtagtgccaacttttggcagtatttcttcacaggtggtggcgtgttcttccatcaggagtcatgtaatgtttggtgatctctcgtgatgttagcagctgttgctgtttgatgccttatcccttaattcattaagggttgcaaaatggagatatcctaatgctatcattttttcatctgttaggtgaagttttacttacataaaaacttcatctcttcttgcttctgctaatggtaaccattctttttcagtatcataataagcttgttaaacaaatttgatgtgttttatagtgccagctaaagtagaagacatcattaagaacaactatgacatcttcccataaaacttcctttgttactatactgcatggattattggtttgatgctgtagagccctattcatgttctcattttcttttccattactggctgatagtaataggatatgcaaaagcatttgcctcagtgttaaaatgtaaacatggcagacattgtttcctcttttcacagatggaactttctgctctacagtccatgatggctgtgcaggaagaagagctgcaggtgcaggctgctgatatggagtctctgaccaggaacatacagattaaagaagatctcataaaggtctttcaaaactttttaaagaccactggaaatgttcacagctcagaatacctgtagggcctcttcagacaatatttgcacacatcgaatcccttggccagtgattatccatatcccacttgaaagtataggcagaatatttcaagacatttgttcccgtgctactctgctgaataatccttttattactattttcacatccatacttattttttgacttctaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacaggtaagttactggaatataaaccttatttatttatttacatttttttgtattcttttttttttttttagtagagatggagtttcaccatgttggtcaggctagtcttgnactcctgactgcaagtgatccatcctcctcggcccctcaaagtgctggaattacatacaagcatgagtcaccacattgagacaaggtctcactgtgtcacccaggcaggagtgcagtggtatgatcacagctcactgcagcctcaaactctggggctcaaggaatcttcctgcctcagcctcctgagtagctggagctgcaggtgcacaccaccacgcccggctcaaaccttatttttctactgtgaaataaaccatggtaaagctgtcaatctcagctatttgtggagggttagttgatggtatttcctagagaaactgtgctctaaaatttcctactttggtcggtagcagctatagatgcccctttctgacatttgtagttctgaaaagagcagcagttcttttggacacataccaatagttatccctcacactcatacctaagtcacctccctcaactgaatctttctcttttatctgcatttaaccatgttcagatctctcccagtt

SEQ ID NO: 367986 - DNA, 457 bp, Homo sapiens
  misc_feature (23)..(23): n is a, c, g, or t
attgactgagatcttaacaacancagcaacgatacatcagcaaatccttattatccagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataac

SEQ ID NO: 367987 - DNA, 9867 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagtgggccttgcctctccctggtcagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367988 - DNA, 8116 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagtgggccttgcctctccctggtcagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367989 - DNA, 9504 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcaggtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367990 - DNA, 9361 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccaggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367991 - DNA, 5948 bp, Homo sapiens
cgagtgggttcctgcacatccaagcgcacccacaagggggaccctctgccatctcttgcccagttgggatacaccagccaccaggcagaggtcatacccacacgagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367992 - DNA, 4965 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtggggaactggaaagtgtgcgaattcatcacaagcatgcctactgagcactggcgggtcagactgcagcccaggatggaaaaccttgtttgcactaaccagaaagatccttgtctgattttggcagaattaaacggtgacttactaatgatagaactggtacaagtagcatcaactacaaagtgaaactcactttagcctacatggatctcactgtacatacatatcaatccctaaattgaatggtggaggttgcaaagtgtatttgcacattttaaatcattctgttttagtttttccacttttattcattcttatccctagccccttctcgttccctcatcccttctgtgggccaataaagtttattcttccccaa

SEQ ID NO: 367993 - DNA, 6253 bp, Homo sapiens
  misc_feature (6222)..(6222): n is a, c, g, or t
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgctaggtatctgagtacagcttggatcaggtgatcgatgacagtttgcgcgaggagacctgggagccttgctcccactccgaaatatagtggagagatggggaacgatctcctcgaggagaccgcaaaagtgcaaaaacggggcccaataaggaggggccccccggcagcaatttntcacaaaacaccgcaccacagcgggcgcccc

SEQ ID NO: 367994 - DNA, 1359 bp, Homo sapiens
atgagaagtgatcaggggggcttggggatgttgggagttgagactgatttgatatccccaaacctcctgtaccaggagcaattgtggctgcagagggagtggaggacagggggtggatagaaggagactccaagctgaatagccagaaagaaataaatgctttagaattctcatgctaagcaagtagggttaatttctgctggtggtttctactctgtggtgctcttttgttgtttcagtaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 367995 - DNA, 4965 bp, Homo sapiens
  misc_feature (4453)..(4453): n is a, c, g, or t
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacaggtaagttactggaatataaaccttatttatttatttacatttttttgtattcttttttttttttttagtagagatggagtttcaccatgttggtcaggctagtcttgnactcctgactgcaagtgatccatcctcctcggcccctcaaagtgctggaattacatacaagcatgagtcaccacattgagacaaggtctcactgtgtcacccaggcaggagtgcagtggtatgatcacagctcactgcagcctcaaactctggggctcaaggaatcttcctgcctcagcctcctgagtagctggagctgcaggtgcacaccaccacgcccggctcaaaccttatttttctactgtgaaataaaccatggtaaagctgtcaatctcagctatttgtggagggttagttgatggtatttcctagagaaactgtgctctaaaatttcctactttggtcggtagcagctatagatgcccctttctgacatttgtagttctgaaaagagcagcagttcttttggacacataccaatagttatccctcacactcatacctaagtcacctccctcaactgaatctttctcttttatctgcatttaaccatgttcagatctctcccagtt

SEQ ID NO: 367996 - DNA, 673 bp, Homo sapiens
ggctagtgcaacttggacatttggttttatttaattttagttgatgtagtataaagtggccatatgtggctgctaactaccttattggacagtacaggtctagggtcttgggactctaaattagttcagctccattcaacatttattgaacccctgcggataaagcacttgccagcttcaatggggctgctagagatgatagtgtacaatccctgacttacagatatctggtcccaactaaagcctgggttatctgaaggggagataatggcaaatgcaggctcctcctttggaaagaaattctgcttcctggagctggtgatctcttctcccaccagttcagagaagcttctctcccactgtggatctgccttccgtgcctcaaaaggttagggtatgtgccattgaggctgagggcatatgtgggaaattcagacattctgtaacacctgcttctcttcccaagcaggtgaatccttggtgaagcaggacagcaagcagatccaggtggacctccaggacctgggctatgagacttgtggccgaagcgagaatgaggctgaacgggaggaaaccaccagtcctggtaagagcacagggtgtggggctcacccctccctggagtcagctgtcacatttggatgctgttggccaattccacacctgacaagta

SEQ ID NO: 367997 - DNA, 752 bp, Homo sapiens
atatgacattgatttgaaaactataaaatagtatcaaaagcttaagtactaagatagtgggctttttaagtcatagtacatgctaatgcattttcttgtttcttattcatgtctcactgtgccatttgcgtattgcttcctctctcttctttactcagttgctgctgatgctagaaggactagtagatgaacggagtcggctcaatgaggccttacaagcagagagacagctctatagcagtctggtgaagttccatgcccatccagagaggtaagagagaggctgttttttcttttattctttattgaaatttttatttcttttactattgtatttatgccttttattcttcattaagtgcagatgcttatgatactgaagaggggagaaaaaagagggacaattaccggggctacccactttgtcatttgttttatggattgctctgagcctcagtgtcaaaatcttaagttgggattagtgcctgtttcacacagctattgcagagattaaataagaagacagcttttgtgtctaaaacaatgccttgcatgtagtaagcactcaatgtatgttcatttcttttctgtgatccatgtcctgttaaaggctgttctattataaacgtaaggctatgccctgtctctactaaaaatacaaaaattagctgggtgaggtagcgcgcgcctgtagtcccagctactcgggaagctgaggcaggagacacacttgaacctgggaggcagaggtt

SEQ ID NO: 367998 - DNA, 6304 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataac

SEQ ID NO: 367999 - DNA, 7172 bp, Homo sapiens
tctcctgctgtcgagctggtaagtaccctctgacgctgtgaaggttgtccaagctggctttggtgcagcatttctcgaagcttgcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagtgggccttgcctctccctggtcagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 368000 - DNA, 9843 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 368001 - DNA, 9657 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 368002 - DNA, 6699 bp, Homo sapiens
tagtttttgtatttttagtagagatgggtttcaccatgttggtcaggctggtctcgaactcctgacctcatgatccgcccacctcagcctcccaaagtgctgggattacaggtgtgagctaccacgcctggcctattatgatttttaatgaagtttgtcataaccaagtacttgtcattttctgatgagaacactgaaagtttagggcatgtagtgccaacttttggcagtatttcttcacaggtggtggcgtgttcttccatcaggagtcatgtaatgtttggtgatctctcgtgatgttagcagctgttgctgtttgatgccttatcccttaattcattaagggttgcaaaatggagatatcctaatgctatcattttttcatctgttaggtgaagttttacttacataaaaacttcatctcttcttgcttctgctaatggtaaccattctttttcagtatcataataagcttgttaaacaaatttgatgtgttttatagtgccagctaaagtagaagacatcattaagaacaactatgacatcttcccataaaacttcctttgttactatactgcatggattattggtttgatgctgtagagccctattcatgttctcattttcttttccattactggctgatagtaataggatatgcaaaagcatttgcctcagtgttaaaatgtaaacatggcagacattgtttcctcttttcacagatggaactttctgctctacagtccatgatggctgtgcaggaagaagagctgcaggtgcaggctgctgatatggagtctctgaccaggaacatacagattaaagaagatctcataaaggtctttcaaaactttttaaagaccactggaaatgttcacagctcagaatacctgtagggcctcttcagacaatatttgcacacatcgaatcccttggccagtgattatccatatcccacttgaaagtataggcagaatatttcaagacatttgttcccgtgctactctgctgaataatccttttattactattttcacatccatacttattttttgacttctaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 368003 - DNA, 5312 bp, Homo sapiens
tggcgcgagctgcattcccagacactccagctcttacggaaagaagcactgtcttttgcgctagtgtttgtctaccgtcccctgtcctaaaataatgactgccctctacctgagggaaagggacttcaatggtggtaatctactcgcggctggctgcatccttaaaaaagcccatttctcttctactatcttcaagatcttggttaaccagattcacattgtatgtgccggactctttctcaggtgactgctctgtgcttttttatctaaagaagggcaagtcacccacgggtactaaccctcccccacccacatcaagggagaaacactcctctactcttttctggacattcctgttcagagtcgaggtaagggttgcacggccccgcccctccgttaccaagccttccctcgcctgcctcgcagcctcaggcccttagaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcaacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 368004 - DNA, 783 bp, Homo sapiens
aatacatgataaagctgttgctctggaggtatgtatcatcatttcgcccactatgctatggattattctatctacataggtattatagaaatttgtgtttgcttaaatttgctgctttgggatttggttttctattctgccatcttgttgaataagagtgatcaggatagtaaatcttacagagctttaggagtcttcctttccttgcagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaagtaagagcaaaacctatctctgacttggtgttcctctcccacttgtatcctgagcctgaagcatgacccccttccatcattttctgaaaaccagggattttgctttataagggggaagaaaaccaaaaagagcagttactagttccatcattgtcaattagcaagtgagagattttagcgcttctacttttcttttgtaatatgaactttgtgaggagagccagtaaatattgatttctgtttacatagttctgatttatttccaattcttgttcatacataagtatacatacacacacgctcttctctctctctcttacttttactgaagcattaccagggtgcaattattaaattgtgtcttctacattaatattatctacatgtccatgaattgccataattagaacacttgtttatctatatttactgtgg

SEQ ID NO: 368005 - DNA, 650 bp, Homo sapiens
ttgtttgtttcttggcctgctcctccctgccctgcgccatacggaacacacagtaggtgctcactggggagtgaaggaaacgcccaccactgagtggctgctcaggggctgagaaccgaaactttgtttaggttttcttctgtgttttccttgcctcaggtttaaacttttttcttaatctttatcttcacaaaggttgaaaaagatcatctagcaaagccttttttcccagctacatataaggaatttgaaagtcgcataaaatggttaagaaaatgtgccaagattacctcagtaattctggtctgtgttctcaggagaccctggaaataaacaatggtaaggtacaatctcccatggcagaaagagtttccctcagagttagccaaaacaagggccaggcgcagtggcttacacttgtaatcccagcactctgggaggctgaggcagatgtatcacttgaggtcaggggttcaagaccagcctggccaacatgacaaaaccctaatacaaaaattagccgggcatggtggtacatgcctctaattccagttattcaggaggctgagacacaagaattcatttgaacctgggaggcgaaggttgcagtgagctgagattgtaccactgcactccagcatatgcgacag

SEQ ID NO: 368006 - DNA, 408 bp, Homo sapiens
gaaacagagttgttgcttaggttatgttggtggaatacctcccctaatgctggttttaaatagcataaactgtctgggtatggtagttcacacctgtaatcccaacactttgggaggccgaggtgggaggatcacttgagcccagaagtttgaggccagtctgggcaacacggtgagtccctgtctctactaaataaataaataaataaatacataaaattagccagttgtggtggtgtgcacctgtagtcccagctacttggggcgggggggctgatgtgggaggcttgttcgagcctggaggttgagcctgtgatgagctgtgaccatgccactgtactccagcctgaatgacagagcaagaccctgtttcaaaaaataaataaaataaatctcataaacttaata

SEQ ID NO: 368007 - DNA, 454 bp, Homo sapiens
tatttttctgaaaaagattttgtgaaattaatgttagacttctttaaaggtttggtagaattctccagtgagaccatatgggtctagagatttctttttgagattttaagctatcaattaagtttctttaatagttataggactattcaaattacccatttcatatggggtgtgttgtcacagtttatactcttccagagaattggtctgcttcattgaagttgtcaagtctatgtgtgtagagttgtttgtagtagtcctttattatccttttcatgtctgcagggtctgtaatggtatcttcagtttaattcctgatatttgtaatttgtgacttttgtctttttatttatttgtcaacatttccagagatttactgatcttttaaaagggaaagctttttgtttcaccgattttttctattgtttttctttcttcaatttcattaactttc

SEQ ID NO: 368008 - DNA, 368 bp, Homo sapiens
tgcattctccactctccccctctgaagattcagaattaagagaaatttggagatgaagatcacctgagtgtcctcattttactaatgatgaaactaggcctaccaagccccttttacagatgactgtatctcttctaaatcaaaactgagaaaaagaatgatgaatgcagctttgacaaacaatagagagaagaacagggacacatgtggaggcaccatgtcacagtttctctcacagaaagagccacatgcagtgggaggaagatagggaggcggggatgccagccagtgggaaactcttcctttagacataccgtacctccagacatttcgatgacataaatttattcattcatatatttaacaaa

SEQ ID NO: 368009 - DNA, 736 bp, Homo sapiens
  misc_feature (1)..(1): n is a, c, g, or t
  misc_feature (114)..(114): n is a, c, g, or t
ngggggagggtctaatagcaaacctggttagtgaccgtcagtccgctaacgatacggcaagctcgaattagccgggcggattccccggggttgcagaattcggcacgagctagnatcaagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368010 - DNA, 560 bp, Homo sapiens
tgtggaatcttggagaatccgacgtccgggcggttgaaatgaaagaggcaaggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368011 - DNA, 1953 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368012 - DNA, 2201 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcagctagcctcctgcattgtatggttataaatagcaccctagtgagtgctgtcgtccagtctctcttgggtgtggtttgaatgatctcgggatgcatgactaaaatggaattacgatggcagatcggaaacgcgtttataaacaagtgatggtttgtgagtcgactgtcaagaccag

SEQ ID NO: 368013 - DNA, 2179 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggtgagtgctctttagctgtgcatagcgggcgcggtctacggatgtcgcaggtcttgggtctttaggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggcacatcatcctgggggggggccgtgttgctcacagccctgcgtcctgctgcgccagggcccgcgccaccgccacaggaggcctgatggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368014 - DNA, 2091 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggtgagtgctctttagctgtgcatagcgggcgcggtctacggatgtcgcaggtcttgggtctttaggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368015 - DNA, 1661 bp, Homo sapiens
ccgcggttttaatttcattacgggctgggcgttttcattgttacattacgtgcggtggtcctacaatctacatccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368016 - DNA, 2024 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtggttttttcttttgatttttcttttgggcagaggcgggggc

SEQ ID NO: 368017 - DNA, 1208 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcgatgacagtgccaacttccggaagcggggctcactgctctggaaccagcaggatggtaccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368018 - DNA, 1049 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggtgagtgctctttagctgtgcatagcgggcgcggtctacggatgtcgcaggtcttgggtctttaggctggggcggaaggtcgagagggcgaggcctgtggcacggtggggctgctgctggagcactcatttgagatcgctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368019 - DNA, 1042 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368020 - DNA, 812 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368021 - DNA, 766 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368022 - DNA, 2026 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368023 - DNA, 2041 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggcacatcatcctgggggggggccgtgttgctcacagccctgcgtcctgctgcgccagggcccgcgccaccgccacaggaggcctgatggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368024 - DNA, 1994 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368025 - DNA, 2695 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaagaagagaggacgcgcggagaaggagagacaagcaaactacaaacataatagagggaccaagagaaaaggaaaaaagaagagaaagaaagagagggaagcgaaagacaaaaaagaaaaaaaaaaaaaaaaaacaaaaaaaaaacgaaagaaaacaacaagaaaaaaaaacaaaaaagagaaaagaaagaaaaagaaagaaaaaagacaaaaaaaacagaaaaaaaaagagaacagaacaagaaagagagaaaaacagcaaaagaaagaagaaacaaagaagaagaaaacagaaaagaaaaaaagaagaaaaaaaaaaaaaaaagaaaaaaaaaagaaaaaaaaggagagaaaagaaaaagagaagagagaaaaaaagagaggaagaagagagacagaaaagacgaaaaaaagaacgagaagaagagaagagaaagagagaacaaaaggagaaagaaaaaaggagaaagaggagagcgagaagagagaaaaaagaaaaaaaaacaaaaagaaca

SEQ ID NO: 368026 - DNA, 1834 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368027 - DNA, 2006 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggccggtgagggcccaggctggtcagcgtcccgtcttgcacacccagggcctccctttctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 368028 - DNA, 1398 bp, Homo sapiens
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccagcccctatccgctatccaataaggtcctctagag

SEQ ID NO: 368029 - DNA, 821 bp, Homo sapiens
caacacaaaacacaaacaacagaaagtagtcataagatagaggccggggggtttataggggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtctgttctatgatgtccagacgcagaaacagggcacgtggacgcggaaa

SEQ ID NO: 368030 - DNA, 2057 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttcccccta

SEQ ID NO: 368031 - DNA, 1418 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatca

SEQ ID NO: 368032 - DNA, 940 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaacagggggttcccatgcagaccagaggacacggaggctggggagcaggaattcggggagacctgtcaagactcggttccagagcaaggcttcagaagcggtgcggggggtggaacagttgagggaaagtgaggcgcaagggtgacaggttaggccgaagggcacaagaagggaggggcagtgggcccactttcaccggacc

SEQ ID NO: 368033 - DNA, 3617 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttccccctaaaaacccttttatgtacacctgcgcagagaagagggctgcctggcctccctgggccgctggtacagatcacacacacacacagattaaacgcagcccgtttaatgatggggcccagactgcagtggctcaagacaggacactgcggaaagccgccatgtgccgccgcacactgtctgagatctgctcagccgatctgctccggccgtagtaatccgtgaagaggccgtcagggttgagcaggtagatggcaatggagtggtccacgatgtagtcctggtcctcatccttggggcctgcattgtagtacacgcggtaactgtgactagcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggaccggaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaaggaggtgggtaactctctggcttgcaatccccgagagcaaccgattcctccaacactttcctgttacctccagccacttcaaccaaccgcggccttcctccacactcccagcagaaaacctgcacgacctacccccggagctcagactctgcccgccggctgtgtttaacctctcctggcagagacgcacgacacttccacccgccacaaaaccccaccctcctcacatccaggcttcccagcagctcctccgggctcacagccga

SEQ ID NO: 368034 - DNA, 1487 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctaataaagcagtgttgccatctcaaaaaaaaaaa

SEQ ID NO: 368035 - DNA, 2112 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagtgtcatttgctgagaaggaatacaggagatgagccagcgttggggaagatgttggctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttcccccta

SEQ ID NO: 368036 - DNA, 2490 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccacgagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttccccctaaaaacccttttatgtacacctgcgcagagaagagggctgcctggcctccctgggccgctggtacagatcacacacacacacagattaaacgcagcccgtttaatgatggggcccagactgcagtggctcaagacaggacactgcggaaagccgccatgtgccgccgcacactgtctgagatctgctcagccgatctgctccggccgtagtaatccgtgaagaggccgtcagggttgagcaggtagatggcaatggagtggtccacgatgtagtcctggtcctcatccttggggcctgcattgtagtacacgcggtaactgtgactagcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggaccggaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaagga

SEQ ID NO: 368037 - DNA, 1193 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccacgagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttcccccta

SEQ ID NO: 368038 - DNA, 2125 bp, Homo sapiens
  misc_feature (1846)..(1846): n is a, c, g, or t
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggtgagtagcctgggatacgtgggagggggagacggtcnccagaccctgctgatgtgccacccctgcaggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttcccccta

SEQ ID NO: 368039 - DNA, 3354 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttccccctaaaaacccttttatgtacacctgcgcagagaagagggctgcctggcctccctgggccgctggtacagatcacacacacacacagattaaacgcagcccgtttaatgatggggcccagactgcagtggctcaagacaggacactgcggaaagccgccatgtgccgccgcacactgtctgagatctgctcagccgatctgctccggccgtagtaatccgtgaagaggccgtcagggttgagcaggtagatggcaatggagtggtccacgatgtagtcctggtcctcatccttggggcctgcattgtagtacacgcggtaactgtgactagcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggaccggaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaagga

SEQ ID NO: 368040 - DNA, 3444 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtgagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttccccctaaaaacccttttatgtacacctgcgcagagaagagggctgcctggcctccctgggccgctggtacagatcacacacacacacagattaaacgcagcccgtttaatgatggggcccagactgcagtggctcaagacaggacactgcggaaagccgccatgtgccgccgcacactgtctgagatctgctcagccgatctgctccggccgtagtaatccgtgaagaggccgtcagggttgagcaggtagatggcaatggagtggtccacgatgtagtcctggtcctcatccttggggcctgcattgtagtacacgcggtaactgtgactagcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggaccggaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaagga

SEQ ID NO: 368041 - DNA, 1526 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatcacctgatgcatacagaggaaatgttaacgtttcttcactctagttggtagatggcatggatatttgtcatattctattcatttttcctagttttgaagaagagtacccc

SEQ ID NO: 368042 - DNA, 2672 bp, Homo sapiens
ttcaagcgattctcctgcctcggcctcccgagtaggtgggattacaggtgtgcgccaccacacccggctaattttttttgcatttttagtagaggcgggggtttcaccatgttggccaggctggtctcaaactcttgacctcgggtgatctgcccgccttggcctcccaaagtgctgggattacaggcatgagccaccacgcccgacccttgtagggttcttgatgttaacccaaggtggagttcctggggtacccagagccttgaggggagaaagaggagaagtggggaccctgtgactgtctttgcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcatcttccccctaaaaacccttttatgtacacctgcgcagagaagagggctgcctggcctccctgggccgctggtacagatcacacacacacacagattaaacgcagcccgtttaatgatggggcccagactgcagtggctcaagacaggacactgcggaaagccgccatgtgccgccgcacactgtctgagatctgctcagccgatctgctccggccgtagtaatccgtgaagaggccgtcagggttgagcaggtagatggcaatggagtggtccacgatgtagtcctggtcctcatccttggggcctgcattgtagtacacgcggtaactgtgactagcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggaccggaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaagga

SEQ ID NO: 368043 - DNA, 702 bp, Homo sapiens
cgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgtgagtcctggcctggcccctcccctccatggcccagccctgagtggggagcaccgaggcaggggtgggggaatgtgtactgaggagccgtgcgtctgctcctggctggcccggcctaataaagcagtgttgccatctcatcttcccccta

SEQ ID NO: 368044 - DNA, 1280 bp, Homo sapiens
taactatcacctttatttcaagacaatttacttgtgtcacaactcttaatatattgtctctcctcagcaggttaaagctgcaagtttctttcctggacaatggcaaatcctccaattctaagagagaaaaaagacagagagataggagagagaaagagaagagagtttacatttgaaaatacattccatatgaaagaacaataagagagaatattgcagctttatacaaaagggtcaagaaacatgaaattgaactacagaaaaagcagaacaattaagccacgttgccaaatcttcagagcccttgcctgcccggaggggctggcatctcacacgaaaataaactttcttcttagtcagtgggccaccagagtttgattaaagagcagggctttcaccagcaagaagcagagtgggtcgttaatgtaacacaatgaaccagtacaaacaaaaaggcacttgagaggacatagactagccagtgccaaggatttgtgtttttgttgttgcggttgtcagcagtatacccagtggccagccgtgttcagggatggcaccgttttctgtatggagttcacaagcacgaggtttagtacaacaccggaaaaacagcaagaaaactggacagtattgcttcgtaaacagagctgacacactacaccagtactgaggctacagtactttaaaaagaaaacagcctaatccttctttgcctatgcacgacgcgggcaattatacacaagtacaacttcaggagtccactgaaatgcggtgattctagtatattctgggcactgggtttcaggtagcatgtccatccaaagggccacacggaatacgcttggtgccagcatcttggatttcgctcagtttccaaaaagaatccacaaaggggagaggagagagagagagaggggcaggaggggtcgaaatgaatgattatgtcaatcatacttggtctcaacaccagcatctgattattcaaatgaaaccaacaggaaaaaagctgactgcacatgagtccgatggtgaacacagctccttgtccatgtctgtcggccatactcattgaagctcctgagaaaagcctggctcagtggtcatcaacacacttcccagcctgtatagtgaaagatcaacagctccccagctcactcccgtccttccacttccgtcctttgactgtcttttcatctctgtctgccttcatgcctccgaataagtactctgtgtattcagtttgtcttttttcaacttcacaccatccacaagttcaaagt

SEQ ID NO: 368045 - DNA, 2819 bp, Homo sapiens
tgtcacttcattactgtgctcttcgtctggcttcgcttctctctttcgttctgtcgtctcgcttttttcttctctctctgggcctctctttcctcttttttctgtttctttttcctttttgattggtttcttgtgtttttttctttgttttttgtttttttttgtgttattttatgaaaatgtttaattcaactgtttctttggaatgtagtagtcatagtttggaatttaagttacagttcagttctatgtggtttttatgctactcagtgtctgagaatacaaatgtcatttaaagttaaggcttcgctgttcattttgaaacaacaatttacaagtgtcatattgtcatagaaaataataatttctgtaaaaaaaatctgcacaaaatcttatgatggtacaaaacatgaagcaataatataccagtaaaatgaaaacattttactacagaaagttttatagatttccataaagaaaaaatatgttattttacacctttaaaaattacaaaacaatctaaaacaatataaactgaacattttgtaacactgcctttacaaattaataactttataaacatataatttttaaatatatttatcagtgcaagatactttaaattttaaagttgcagtatcatttttccttggctgaggacaactttaagtctgttgcctttaaaaacaacaaacgagtgtttcttagtgctttccttctggtaggattatatcaactaaatgaatgtctctggggacaaaaaactattcttctttcatggtgatcaatattttcctggaaacaaaaggcattctcaatccaatttaactaagatgaatggactgtctcgtctatgatgcaaatgtgactcccaacaaatgtctttgagtgagacgtctagcaatgtgggaaggaagatctaaaaaatctcatgtccaacatggcatgataaaaatccaccaaaaccaaccaaagcttctttgggttaattcataggctgcctggtaagatatttgcttccctgtgctgttagaggcttagatgttgccagccctaaggcaggcttattctttgtgagccgctggaagtttctagaagcattcatttaagtctattttttcaaggttgctgttatgaatttttaaaacatttgtttgactttatgtgtttttccccctcttatcttaaaatacttgacccccaggcatcaggatttatagtttcattcttaaattaactgttcttccttccacttcccttgtgtgactcagtagcaaaataagaaagttctcttgggtcatttttgcatatttggatagaaaaatctcatgcttttggatttggaagattttatccagttcttcctttgggtctcacttgaaagccaatttgtattatttctttcctcaacttatcactatttctactaaatgccaacatttctatcaaaggtcattttgaatagaatagataaggaaaaaagatactgtcactttaaccagttaacaagaaaaccaaagttagactttggagggcaaagttaggaatttcccttatttatttatttttaaacataaagtctagtaaaatcgtttgccattcccagcaggttaaagctgcaagtttctttcctggacaatggcaaatcctccaattctaagagagaaaaaagacagagagataggagagagaaagagaagagagtttacatttgaaaatacattccatatgaaagaacaataagagagaatattgcagctttatacaaaagggtcaagaaacatgaaattgaactacagaaaaagcagaacaattaagccacgttgccaaatcttcagagcccttgcctgcccggaggggctggcatctcacacgaaaataaactttcttcttagtcagtgggccaccagagtttgattaaagagcagggctttcaccagcaagaagcagagtgggtcgttaatgtaacacaatgaaccagtacaaacaaaaaggcacttgagaggacatagactagccagtgccaaggatttgtgtttttgttgttgcggttgtcagcagtatacccagtggccagccgtgttcagggatggcaccgttttctgtatggagttcacaagcacgaggtttagtacaacaccggaaaaacagcaagaaaactggacagtattgcttcgtaaacagagctgacacactacaccagtactgaggctacagtactttaaaaagaaaacagcctaatccttctttgcctatgcacgacgcgggcaattatacacaagtacaacttcaggagtccactgaaatgcggtgattctagtatattctgggcactgggtttcaggtagcatgtccatccaaagggccacacggaatacgcttggtgccagcatcttggatttcgctcagtttccaaaaagaatccacaaaggggagaggagagagagagagaggggcaggaggggtcgaaatgaatgattatgtcaatcatacttggtctcaacaccagcatctgattattcaaatgaaaccaacaggaaaaaagctgactgcacatgagtccgatggtgaacacagctccttgtccatgtctgtcggccatactcattgaagctcctgagaaaagcctggctcagtggtcatcaacacacttcccagcctgtatagtgaaagatcaacagctccccagctcactcccgtccttccacttccgtcctttgactgtcttttcatctctgtctgccttcatgcctccgaataagtactctgtgtattcagtttgtcttttttcaacttcacaccatccacaagttcaaagt

SEQ ID NO: 368046 - DNA, 1808 bp, Homo sapiens
tgtcacttcattactgtgctcttcgtctggcttcgcttctctctttcgttctgtcgtctcgcttttttcttctctctctgggcctctctttcctcttttttctgtttctttttcctttttgattggtttcttgtgtttttttctttgttttttgtttttttttgtgttattttatgaaaatgtttaattcaactgtttctttggaatgtagtagtcatagtttggaatttaagttacagttcagttctatgtggtttttatgctactcagtgtctgagaatacaaatgtcatttaaagttaaggcttcgctgttcattttgaaacaacaatttacaagtgtcatattgtcatagaaaataataatttctgtaaaaaaaatctgcacaaaatcttatgatggtacaaaacatgaagcaataatataccagtaaaatgaaaacattttactacagaaagttttatagatttccataaagaaaaaatatgttattttacacctttaaaaattacaaaacaatctaaaacaatataaactgaacattttgtaacactgcctttacaaattaataactttataaacatataatttttaaatatatttatcagtgcaagatactttaaattttaaagttgcagtatcatttttccttggctgaggacaactttaagtctgttgcctttaaaaacaacaaacgagtgtttcttagtgctttccttctggtaggattatatcaactaaatgaatgtctctggggacaaaaaactattcttctttcatggtgatcaatattttcctggaaacaaaaggcattctcaatccaatttaactaagatgaatggactgtctcgtctatgatgcaaatgtgactcccaacaaatgtctttgagtgagacgtctagcaatgtgggaaggaagatctaaaaaatctcatgtccaacatggcatgataaaaatccaccaaaaccaaccaaagcttctttgggttaattcataggctgcctggtaagatatttgcttccctgtgctgttagaggcttagatgttgccagccctaaggcaggcttattctttgtgagccgctggaagtttctagaagcattcatttaagtctattttttcaaggttgctgttatgaatttttaaaacatttgtttgactttatgtgtttttccccctcttatcttaaaatacttgacccccaggcatcaggatttatagtttcattcttaaattaactgttcttccttccacttcccttgtgtgactcagtagcaaaataagaaagttctcttgggtcatttttgcatatttggatagaaaaatctcatgcttttggatttggaagattttatccagttcttcctttgggtctcacttgaaagccaatttgtattatttctttcctcaacttatcactatttctactaaatgccaacatttctatcaaaggtcattttgaatagaatagataaggaaaaaagatactgtcactttaaccagttaacaagaaaaccaaagttagactttggagggcaaagttaggaatttcccttatttatttatttttaaacataaagtctagtaaaatcgtttgccattcccagcgagtgatgtataaacacgtgacatagatctttctatgcactgccacaaaggacttatctctccccacttttcgagagacgccggacgatctatgtatgtagatgagtgagaaatcaagacgaatgaagccgatggtacatggagctcattacagtttccatactatagagcacgatcagagagcatactggcaccgcgata

SEQ ID NO: 368047 - DNA, 321 bp, Homo sapiens
ttttttcttagaaactggacattgtagatatattgtagcagctcctagctctgcgtctcctctgtggcttgttactttcatttgccagtttgtttagtgactggctgaattattttagtaaagtctattatgtcccccagcccccaccgttgttccttagggaagcacagttttgggtctgccccagtcacgctgggagaacaatggttttggtagggcccccttcctgtctttccttgcccatgcccagctgttaaacttcactatttgctggctgattattgttttcaacaatgtcctggggtataaattgctttacaa

SEQ ID NO: 368048 - DNA, 291 bp, Homo sapiens
tactactaaattcgcggccgcgtcgacagaaaatttaaagccctttgcattttaagaaggttgtgtgcttgtagtaataacttacacttctgttgttgaattgatggcagttaaatgcttatttggatacattaagcagacataaagaaatacagacttttagcctggcatgttggcttgtgcctataatcccagctattcaggaggctgaagtgggaagatggcttgaagccaggaattcaagaccagtctgggcaacatagtaagactctgtctctgaaaaaaaaaaaa

SEQ ID NO: 368049 - DNA, 507 bp, Homo sapiens
actcttatttcatataaggagaaagtgcagtatggaaagtgtaaatgacttaagcatgaaatcactgacaggtctgtgaatgtctgttagaacaagattgtgagaatggtgaaagattgaagagtttgattagatctatttaattctgttagtagaccacaatttttgtgaaaattttaagaactattacagagcttccgtgttttatttaaaacgattaataaaaatggaaagtggtacatgagaaaatttaaagccctttgcattttaagaaggttgtgtgcttgtagtaataacttacacttctgttgttgaattgatggcagttaaatgcttatttggatacattaagcagacataaagaaatacagacttttagcctggcatgttggcttgtgcctataatcccagctattcaggaggctgaagtgggaagatggcttgaagccaggaattcaagaccagtctgggcaacatagtaagactctgtctctgaaaaaaaaaaaa

SEQ ID NO: 368050 - DNA, 1942 bp, Homo sapiens
ggggggccgtgcggacctggggaagaggattccaaacagaaaaatgccaagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttataccgtcattccttggactctgctctatctttagaggtcactggctcaagtcagccactatgagacacctgggaaaactgccccaccttgtggctccactgcctgatgactgaactgacctccggacttgactctgttctcccctgtgttatttctgctgaagtacccagtcccaggtcaggctttccagtatccaaagggtttaaagacaattggaagttccatcacccatctctaggatgtccttggcaagggaagctgcagagaaaacatacctcgggcggcaaagtaagactgaaactaagaagattccagcactgcatgctccaagtgaggaccacaagtggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368051 - DNA, 2278 bp, Homo sapiens
  misc_feature (2021)..(2021): n is a, c, g, or t
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttcaaaaaaaaanaaaaaaaaaaaaagaaaagcaacgacatacaacatcaatcacaccacaaacatgaaaacagacgcaagacaaagaaacgcagaaacacgaagacaacaaacgacgacagacacggcacacgagacaaacaacgatgacggcgcggcaggccagacgatcgatataataacggccaggccgcgacccatgtgagacacgagcgtccgccacgccacagccacgagaggatctaccacaaacgggcgcgcaccagaagt

SEQ ID NO: 368052 - DNA, 1348 bp, Homo sapiens
cctggctcttaactagggcagttgagaggcagatcatcatgcctctactttcttagcagagacaaggaagactgtgactgtatttcctaagttcagagccaggcctggctctgaacttaggggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368053 - DNA, 1303 bp, Homo sapiens
tgactcacagcttgaagctgtccgaaaccaacaggaccctctttctattgggtgtcacaaagtatactgcaggaccggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368054 - DNA, 1102 bp, Homo sapiens
tctgcaggacctgtgcagacacctgcatttcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368055 - DNA, 1667 bp, Homo sapiens
  misc_feature (45)..(45): n is a, c, g, or t
agagaattatgacaggtttgagaactaagtgaaccgtatgccatncatgaaaagaaagaagaggtatgagattaggggagaaaagagggagacaaaaataattcagtttgcacatgtttagtttcagatgccattaagacttctatcttctatgggccaatgtgcgtaaaacatccccctccccccacagagagagcgtcgacgatctatgggggcaaagtaggatggaatttggaaggggcccaccagttgcacattccaggtaaggaacccagggtgagccagccagtcaactgattatggagggactgggaggggtaccaggggctgtgactcccattgacgtgtctgtccatgacccaacactgctgctcaattgacacttgagaaagtctgtgcttccctaagacagagcagctggcctcacagtctttgagcccttagatcatcatgcatctgtcttgtgacacacgcaccagctattggctttcaaggactcgggtgggctgagaggtgggagatgccaactctgattgaaggatgccagtggaggaatcaaaggtgccacacaggacaatcttctctctgttatccacacagcgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368056 - DNA, 1573 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368057 - DNA, 843 bp, Homo sapiens
gggcaggtacgggatggtggggatcgaggttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368058 - DNA, 756 bp, Homo sapiens
aaatgttagtaacttagtttctttcttttttttaagatgaaaattatatatatatatccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368059 - DNA, 1843 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgatgctttcaataatccaacgtagcagccgtgatgtcatttttgtatttcaggaagactggcagacagttgctttgattcttcctcaaagtatttaaaatcagctacagtccaaagttgctttttgttcaaggagacttatgaaaagactctgacctaactctgc

SEQ ID NO: 368060 - DNA, 1944 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368061 - DNA, 1606 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggcccgcacatccgtactggccacgaggtattaagcccacacatgcaattagctgtttatcctgatgctctcccgtcccctcagccacatcacatactgct

SEQ ID NO: 368062 - DNA, 1681 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgtgtatgggatcagctcgaatcagggaggaggaccctggcagaacgtgacatcgaagagggagaccctataccccaggaaagcgagaaaggtaaaggagacgacagctggcgcgtgcagtttgtacgagcaagagagtcgaaacgtgcagacgccgcacgcgcttcgtaaacattctcagcgatcaagggaaagggtctcaca

SEQ ID NO: 368063 - DNA, 1052 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagcctgtccctcggcacagcctcggcacaaaccacattgcctgggtgggggcccagtgttacttgaaataaagtcgtttccgataggacacgttc

SEQ ID NO: 368064 - DNA, 1051 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgtacctcacccgtagctgtacctcacccgtagctgtacctcacccgtagctgtacctcacccgtagctgtacctcacccgtagctgtacctcacccgta

SEQ ID NO: 368065 - DNA, 270 bp, Homo sapiens
ctctctgttttctgcacagtggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgc

SEQ ID NO: 368066 - DNA, 2012 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368067 - DNA, 2882 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttcagtaaggatctgctctctttataacaggacacatttgaaaacattggttatattaccaaggctttgactgggatgttatatttgagaatatacatagaataaacccatagggaatgcaggcaaagtctgaagttggccttggtttggcttcttagtctcaagaggtttttggaagtttaatctgagattcttactaaaaacttccagcaaaggggagtttaaaaagagcctctatggtccatcgctactcttgccgcacttaggtaaaaaatctgggcaagttcggtgagactcaacctattttgcaaaagagttcatcctactggaattatctttggtaaaaatagagactcctataaagagaaaaactatgttgaaaagaaaaactgtagtacacctgttaccagattgaaccactgttcattatctttgagtacttataatccactggtagactggactggaccctgaattcttttagttcttccaatttaattttctccagtgaaatcattaagaacaagagcagctctgttcctgaagccatataagatggagatggacaactcaatgtaaatttcatggagaaaccctcgtgtctgaagtgtgggccactaagagctcaccaaatgttcaacaccataacttagagacactcaaactgcaaaccacgacaagttgatgactttacactgtggacagcttttctcaagatgttagaacaagactatcagtcatgatgagactgttacctctcttaatttgtccttgcttctgcctgtctcctttgcttcccagaataatgctgtacttaggatttcacaagaagtagcttctgagagtaagttaacagtgtccgatatatcatgtc

SEQ ID NO: 368068 - DNA, 1491 bp, Homo sapiens
agcttaacctgtgatcctgagactccggacgcaagctacctgtggtggatgaatggtcagagcgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368069 - DNA, 1852 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatcgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368070 - DNA, 1733 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctccatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368071 - DNA, 826 bp, Homo sapiens
tggcatccgcagttacccagtcgccctgaatctcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368072 - DNA, 1757 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 368073 - DNA, 719 bp, Homo sapiens
gggcgggacaactggtctgagtactatggctgattttcgctgtctggcattgagaagccacacgccccttttgcttaggaggcctctctgctggaggatgacgatggcatggtttatctaaggccactgacaagtcatcaatatagggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcatcacttttaaacttctggaacccgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttataccttaagactcccgagccctccatctccagcagctacacagacggctaaggtctc

SEQ ID NO: 368074 - DNA, 238 bp, Homo sapiens
ctccttaagatcatttctctacaaactgccattttcagaacaccttttacttctctagagcatagcattcagtctattggtgtactgtcttttcatagataaaagctattctttctttactggtatgcctttgctactgtactgtgagctctgagagcacggatcttgtcatttacattgttgttccccagaatctatacagaatctagtacacaataaaatagatgtatatgatgat

SEQ ID NO: 368075 - DNA, 463 bp, Homo sapiens
atcttctttcatgatgtgaacattgtttttttttaaaaaaaactgtaatacatactaccattaattaaaacttgcatttaacatcatatacatacagaagaaaatactgtattcatagtgtgtttaataatacttgtcagtgaatatgtctttttattttttaattataagatgaaaaaagtggcactgtttctggagagtccatagtatatagcaaacacatataatttttgtacttgccactttattttacatttatttgcatacttgcatgtctttcaagatgatatatacttgatttggcttaaaaattctatcatttgttcagtctttccatatgaataatgtctttctatatggattgcatttattaatgcttatttatatagtgtcttagcatgatgagacaatataataatatgaaaaagactggtatttgttgggacaaggaaatgaatcagat

SEQ ID NO: 368076 - DNA, 703 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacac

SEQ ID NO: 368077 - DNA, 618 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctattt

SEQ ID NO: 368078 - DNA, 664 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacac

SEQ ID NO: 368079 - DNA, 819 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagatgaggaaacagacttggagaggttaagtgacatgctcaagacaacactgctgggtcttgctgcgtacgttgcccaggttggaatgcagtggcgtgatcatggctcactgtagcctcgacctcctgggctcaagtgatcctcccgcctccgcctaccaagtagctaggaccacaggcgaagccaccacgcccggataattaaaacataaaaaattcatagaaacagggtctcctatgttccccaggctggtctagaactcctggcctcaggcagtcctactgcctcaggcccccaaagtgctgggattataggcaggaggtaccatgcccatgcagttacaaacattttatagtgtttgccccaaaactttcattggatgtatgcaactttctcttcctctattcctacttttgcaatggtgtactttgtaacaataacacttcctcagaggtccaagatagcctc

SEQ ID NO: 368080 - DNA, 724 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgaggtaactcgccaagttcctatgcctcatctgtgttgtctcttgcaagctggagaaaacttgggatctgcttttactaggtggctatgcacaagggaaaactttgttatcgtgaactgaatagtatcaagttatgggtagcttgttttattagcagtactaatgcttcttggtgtacagacgtacaaattacgtttgagtcaaaggattgaacttttattgcgaaacacatattcttgagggatactgtctgaatcatttttcttggtggcttttaatcgatcttttgggatgttgctacgtaaaaaccgcatattaaaattaagaaacccttcgccgggcgcgatggcccacgcctatcatcccagcactttgggaggccaaggctggcggaccacctgaggtcaggagttccagaccagcctgaccaacatggtgaaaccccgtctctactaaaaatacaaaaattagccgggcatgatggtggatgactgtaatcctatctgttcgggtggct

SEQ ID NO: 368081 - DNA, 1135 bp, Homo sapiens
tgcgacagccgtcactgacggccggagctgtttgtgctgggagctggtggcgcggtgcagggctcttaagaacgaacggcttgggcgcgggtaatcagctccctttcccccactttctcacttattctaggtacttgggactgtcgtagagtttccagaccccatgtaggcgcccagtcgtggactgtcccactctgctgctctactgctcgtggtgctcccgcgcccagactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagtagtttttgttctgtatgacaaatattttacatgattgaattgttttatgaatttctctttttcttctgtcttcaaatgctgcagagttttacaacagagagaaaatacagcagtcaagtataatttaaaaaattcagccaatttttctcagcattgtttctggacctttctgagggtgggatctgggcatcttcaatggcttaacaagtatcacaggtgattctaatgtacattaaagttggagtactaataaaagcattgcaaaggggatacaatat

SEQ ID NO: 368082 - DNA, 863 bp, Homo sapiens
ccaccacaaccgccacatcacagatcgaatgcatcggttacaagatgatactctccatcgtcgagtacatcagttatcagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagtagtttttgttctgtatgacaaatattttacatgattgaattgttttatgaatttctctttttcttctgtcttcaaatgctgcagagttttacaacagagagaaaatacagcagtcaagtataatttaaaaaattcagccaatttttctcagcattgtttctggacctttctgagggtgggatctgggcatcttcaatggcttaacaagtatcacaggtgattctaatgtacattaaagttggagtactaataaaagcattgcaaaggggatacaatat

SEQ ID NO: 368083 - DNA, 555 bp, Homo sapiens
tgcgacagccgtcactgacggccggagctgtttgtgctgggagctggtggcgcggtgcagggctcttaagaacgaacggcttgggcgcgggtaatcagctccctttcccccactttctcacttattctaggtacttgggactgtcgtagagtttccagaccccatgtaggcgcccagtcgtggactgtcccactctgctgctctactgctcgtggtgctcccgcgcccagactggtatccggggactgtgacttgcagggtccgccatggagccagagcagatgctggagggacaaacgcaggttgcagaaaatcctcactccgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgt

SEQ ID NO: 368084 - DNA, 995 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagtagtttttgttctgtatgacaaatattttacatgattgaattgttttatgaatttctctttttcttctgtcttcaaatgctgcagagttttacaacagagagaaaatacagcagtcaagtataatttaaaaaattcagccaatttttctcagcattgtttctggacctttctgagggtgggatctgggcatcttcaatggcttaacaagtatcacaggtgattctaatgtacattaaagttggagtactaataaaagcattgcaaaggggatacaatat

SEQ ID NO: 368085 - DNA, 882 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacacctgaaaaaaaaaaaaaaaaaaaaaattgtggggggtccggcctgagaagttttaaacaattctgttgggggggccccgaggtatgaacatgcaaaggccaagaacctcggcacaggggggttccacaaaaaggggggagggggtgaaacacaaggtggggtgttaagggctgaaacgga

SEQ ID NO: 368086 - DNA, 560 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacac

SEQ ID NO: 368087 - DNA, 649 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacac

SEQ ID NO: 368088 - DNA, 720 bp, Homo sapiens
tgcgacagccgtcactgacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagatgaggaaacagacttggagaggttaagtgacatgctcaagacaacactgctgacggggtttcaccgtgttgcccaggctggttgcgaactcctgagctcaggcaatctgtccgcctcggcctcccaacgtgctaggattacaggcgtgagccaccgtgcccggccaattttttttttttttttaagaggtgaggtctcactatgttgcccagatggtctgtctcaaacccctgacctcatgagatcctgctgccttggcctcccaaagtgctgggattacaggtgtgagccactgtgcctggcaaggaatgtcttttcctgccagtccacataatacttacttgagtatttatgtgccaggcagca

SEQ ID NO: 368089 - DNA, 843 bp, Homo sapiens
tgcgacagccgtcactgacggccggagctgtttgtgctgggagctggtggcgcggtgcagggctcttaagaacgaacggcttgggcgcgggtaatcagctccctttcccccactttctcacttattctaggtacttgggactgtcgtagagtttccagaccccatgtaggcgcccagtcgtggactgtcccactctgctgctctactgctcgtggtgctcccgcgcccagactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacac

SEQ ID NO: 368090 - DNA, 717 bp, Homo sapiens
attaaaactattctaaactacatttaaggagacaggatggagttatgttcacattagaaaaaaagatgattttgataaaaataattgctctttaaactacctcacattggttgtttttttgagataatagacattgaaactagtatagaacatttccatcttaatccacctgtgatatagattgtatagcttagggataatttaagatagtaataataactgcggcagataatcgtatttttgctattaacagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacaggtaggatataatcttatgagtaaatgtgtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368091 - DNA, 312 bp, Homo sapiens
gtatctttgcttatcttgcccagtacccgatgccacgtggaaatggagtggctcttaattaagacaggatttcaccatgttgcccaggctggtctcaaactcctgggctcaagcagtcctcccaccttggcctcccaaagtgctgggattacaggcatgagccactgcactcagccacattacctatatcttaaagccaaattatgttgaattcacaagtaacaaatgttcatcgagaaaaatgagaaaatacagacaagcaagaagaaaaaaataaaagcattgatagtcctaatcacaattaaaaaattg

SEQ ID NO: 368092 - DNA, 1133 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagaagctaaagaaactcctgggatttctctcagattttgttgtgaatcaaaacacctcaggagttaagcattcctaatgattagaggtcagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368093 - DNA, 1123 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacaggtaggatataatcttatgagtaaatgtgtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368094 - DNA, 846 bp, Homo sapiens
gttaagcagaccaattaaggagctcctgctggaatcaaaataagaggtaccaaagataatactaagagatgtaatctcagagaaaaaatttccaaatacatggacagagcggaaaacataaagaagtacttggaccaagaaaaagaagaagctaaagaaactcctgggatttctctcagattttgttgtgaatcaaaacacctcaggagttaagcattcctaatgattagaggtcagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368095 - DNA, 1085 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagacaggatttcaccatgttgcccaggctggtctcaaactcctgggctcaagcagtcctcccaccttggcctcccaaagtgctgggattacaggcatgagccactgcactcagccacattacctatatcttaaagccaaattatgttgaattcacaagtaacaaatgttcatcgagaaaaatgagaaaatacagacaagcaagaagaaaaaaataaaagcattgatagtcctaatcacaattaaaaaattg

SEQ ID NO: 368096 - DNA, 957 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368097 - DNA, 693 bp, Homo sapiens
ttaaagcagaggtcagggtccagggctcctcctgcacattccccatctctaggtaggggaactcttgaaacaccaccagtttccctgaatacactttgccaccacttgttagcagaacacgaaaaagttttatcaacaagctgaaattcaagattaaactatcagataattaaatcaactgattgtttctatgactgttttcattgtggacacagctcataatgaaccccaggtttgattcaactcatgccactggaggaagtggtttgctttgttagggggaaattttgctgacacttaatacactacagctttattaatagtctgacttaaatgtcttgaatataatactatatactaatttcaacaggttcaacaatggatggatgattaagattggaaggggacttgattattttaagaaaccacaggtaggatataatcttatgagtaaatgtgtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaa

SEQ ID NO: 368098 - DNA, 1044 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368099 - DNA, 966 bp, Homo sapiens
atgctgaggtactctgaggacccggtcgctcggacacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368100 - DNA, 3471 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaaggtaaagaggttgttttagaaaatgcatccataaacaactgtgactgtccattcacccaatgtttctggctcctgccctttggagctctgtgtggtctggaccagttgtccctgggagcttacaggatttaatctgtatttccactcccatacaggagttgttcttaattttttgtttgtttgtttgttttggcttttgtttttagttgggggtgggaatatcagacacccctttgaacatctcatgaaagctatacttactggagaatgttccatgccatttttaaggggttcacaaatccctatgaagcttatgtgtggaccctatgttaagaaatactacagggaatactgaatgtaaattgtgtattttatttatatttccctttatgaaatgaccaaaatcatgaaagaagctaaagaaactcctgggatttctctcagattttgttgtgaatcaaaacacctcaggagttaagcattcctaatgattagaggtcaggtaggtattgttccctattattagttccctactcctaagcatccagtttacaaatgtctgtaaatggccatttccacccttacctgagtgcatacttgctgctttctatagccaaaggtactgctgccctcaaaagccagtgcccccaggccccagcttttcttcctctctatactttctacacccctttccccatctcttcctactatcctgtatcagtacataccctggggaccccccactgagctcctttgttcagtgggaataaagttatgtttccttagccccgatttgaaatttagaatgaaattttactccaaaacattgatgaaatatagtacctccagcattgtggttttgagtacatggaattaaattaacctctatacggctatcttggcttaaaaaataaggcatagttgccaatgttatctatgtggaaatatttggaacagaatccaaactactgatttttaaacaaagtgtaaagtataatttaggggctaccattagggtttttttttttttttttagacggagtctcgctgtgtcgcccaggctggagtgcagtggcgcgatctctgcttactgcaacctctgcctgctgggttcaagcaattcttctgtcccagcctcccgagtagctgggactacaggcacccgccgccaagcctggctcatttttgtatttttagtagagttgaggttttgccatattggtcaggctggtctctaactcctgacctcaggtgatcctcccgcctcagcctcccaaagtgctgggattacaagtgtgagccaccatgcccagccaggggtcatatttttttaaaaccttaaaggtttctgataactttttcaatattcattttgaatgaacaaaagcaatagatctatcctcttgatcctgtgacatcccagtctttagcttattaagaagtactataaatttctgtttaaaactgtacacgtgccaagaaagactttgaagcttcatattatactgcattaatttttttttttttttttaaggcagagtcttgctctgttgcccaggctggagtgcggtggcatgatctcagctcactgcaacatccacctgggttcaagtgattctcctgcctcagccccccaggtagttgggactacaggcacctgacatcatgcctggctactttttatatttttagtagagctggggtttcaccatgttggccaggctggtctcgaactcctgacctcaaatgatctacctaccttggcctcccaaaatgctgggattacaggcgtgagccaccgcgctctgccctgcattcatgtttaatactcactttagttattagattgcaagacataaaaagacaagtctgaagaggaggaccagatagccactgagtttcagtatgtggtgctacccatggcgacagggagttattggatacctttatatatacactactcccttcaacaaactgcctggtctataggatcttgctcaaggacctgttccaggaaacctctagattttcccccttgcctagcctctgtgaaggcagaaatcactaatggagtggtttgccttaaatacctttgtacgtgtaacatcctgcaatgtatatgatatttagtaggcattcaataagtatttgctgaataagttaaaaaaattaatatgtatctgatgctgattaatcactctatataaaatataaaatgtgtaaaaaaaaaatggtcactggttttactgttgaagcctgtgttttatagatggaaaatatcacaagcaaattaaaatagaagagaatgcaacaggtttcagttatgagtcactttttcgcgaataccttaatgagacagttacagaagtttggatagaagatccttatattagacatactcatcaggtatgtgaacatactaaaatataatgaaatatcatattcaatgtactaaattagtaataatccattctaatgtcttttagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacaggtaggatataatcttatgagtaaatgtgtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368101 - DNA, 904 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacaggttcaggtgctgataatactgaatctgaaaaattttagactcaaactaatttactaagctgtatcata

SEQ ID NO: 368102 - DNA, 1212 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagaagctaaagaaactcctgggatttctctcagattttgttgtgaatcaaaacacctcaggagttaagcattcctaatgattagaggtcagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacaggtaggatataatcttatgagtaaatgtgtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 368103 - DNA, 3131 bp, Homo sapiens
cgtcgcagtgagcgcgacctccaaactgaggcatttttgttccggcgaaatccctcccactcaggaaagtccctagaaagagagcgcaggcgcccctgggtatcacatgacccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaaggtaaagaggttgttttagaaaatgcatccataaacaactgtgactgtccattcacccaatgtttctggctcctgccctttggagctctgtgtggtctggaccagttgtccctgggagcttacaggatttaatctgtatttccactcccatacaggagttgttcttaattttttgtttgtttgtttgttttggcttttgtttttagttgggggtgggaatatcagacacccctttgaacatctcatgaaagctatacttactggagaatgttccatgccatttttaaggggttcacaaatccctatgaagcttatgtgtggaccctatgttaagaaatactacagggaatactgaatgtaaattgtgtattttatttatatttccctttatgaaatgaccaaaatcatgaaagaagctaaagaaactcctgggatttctctcagattttgttgtgaatcaaaacacctcaggagttaagcattcctaatgattagaggtcaggtaggtattgttccctattattagttccctactcctaagcatccagtttacaaatgtctgtaaatggccatttccacccttacctgagtgcatacttgctgctttctatagccaaaggtactgctgccctcaaaagccagtgcccccaggccccagcttttcttcctctctatactttctacacccctttccccatctcttcctactatcctgtatcagtacataccctggggaccccccactgagctcctttgttcagtgggaataaagttatgtttccttagccccgatttgaaatttagaatgaaattttactccaaaacattgatgaaatatagtacctccagcattgtggttttgagtacatggaattaaattaacctctatacggctatcttggcttaaaaaataaggcatagttgccaatgttatctatgtggaaatatttggaacagaatccaaactactgatttttaaacaaagtgtaaagtataatttaggggctaccattagggtttttttttttttttttagacggagtctcgctgtgtcgcccaggctggagtgcagtggcgcgatctctgcttactgcaacctctgcctgctgggttcaagcaattcttctgtcccagcctcccgagtagctgggactacaggcacccgccgccaagcctggctcatttttgtatttttagtagagttgaggttttgccatattggtcaggctggtctctaactcctgacctcaggtgatcctcccgcctcagcctcccaaagtgctgggattacaagtgtgagccaccatgcccagccaggggtcatatttttttaaaaccttaaaggtttctgataactttttcaatattcattttgaatgaacaaaagcaatagatctatcctcttgatcctgtgacatcccagtctttagcttattaagaagtactataaatttctgtttaaaactgtacacgtgccaagaaagactttgaagcttcatattatactgcattaatttttttttttttttttaaggcagagtcttgctctgttgcccaggctggagtgcggtggcatgatctcagctcactgcaacatccacctgggttcaagtgattctcctgcctcagccccccaggtagttgggactacaggcacctgacatcatgcctggctactttttatatttttagtagagctggggtttcaccatgttggccaggctggtctcgaactcctgacctcaaatgatctacctaccttggcctcccaaaatgctgggattacaggcgtgagccaccgcgctctgccctgcattcatgtttaatactcactttagttattagattgcaagacataaaaagacaagtctgaagaggaggaccagatagccactgagtttcagtatgtggtgctacccatggcgacagggagttattggatacctttatatatacactactcccttcaacaaactgcctggtctataggatcttgctcaaggacctgttccaggaaacctctagattttcccccttgcctagcctctgtgaaggcagaaatcactaatggagtggtttgccttaaatacctttgtacgtgtaacatcctgcaatgtatatgatatttagtaggcattcaataagtatttgctgaataagttaaaaaaattaatatgtatctgatgctgattaatcactctatataaaatataaaatgtgtaaaaaaaaaatggtcactggttttactgttgaagcctgtgttttatagatggaaaatatcacaagcaaattaaaatagaagagaatgcaacaggtttcagttatgagtcactttttcgcgaataccttaatgagacagttacagaagtttggatagaagatccttatattagacatactcatcaggtatgtgaacatactaaaatataatgaaatatcatattcaatgtactaaattagtaataatccattctaatgtcttttagctgtataactttcttcgattttgtgagatgcttattaagagaccatgtaaagtaaaaactattcaccttctcacctctctggatgaagtaggtacctgaaagcacttactctttcttattaactttattcagttacaagatgtagtccagtcaaggagaacacagatgcagtgcttcagctagatttgtttccttgggaattaacttatta

SEQ ID NO: 368104 - DNA, 810 bp, Homo sapiens
agatgagtttgtctagagaggctgtagcataggattgtggggccaaggatgagattctgggttacagacgtgcctaaggggctttgcttatagaaaggaaactgagagcattgctgggccatcaggttcatcaggctttacagtgctgtagtgatgtctaggaccattcttttccaggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaattgtaagtgagcccaggtgcccgggtgaggagcaggctcagcctcccctcccactcccaaccctgccctctcccttcagttctgttcgtcctcaccctggggcagaaggcaagctgctatgtgaccagatgtggtatgtctttttctgtagaagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgaaaaaaaaaaa

SEQ ID NO: 368105 - DNA, 558 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcggttgttcccacagcctggaagtctcttccctgacttgttccacgatcaacctctactcacccttcaaggctcagctcaaatgccccttgccccagaaaccttccacaagtcctgaaggcatcactgaaccccatttccaggatgagcccacagcactgcatacaatgagttgagcagtaattatttgtatctggtccaggttcccaatgattaactccttgagagtaggaacactatcacgttcatcttggaatcctcagtgactgacacagagcttgctgtacaagaagccctcaaaaaatgtgtactgaatgaataaaatgcatgtcctagatgtttgtatctcatagcaactcttattttcatatctgccagtgtgctgaggaatggagtggggaggctgagctcctgtctgaataaacaaatgagacagt

SEQ ID NO: 368106 - DNA, 609 bp, Homo sapiens
ccagtgttctttggagtccggggaagtttggcctttaaaaatcaaactgccatggacactgctttacccaaaattttggttcacattcttcactggattaactattggggcaaacaacgtataaccatgtaaaaccagtacgcttgtattggcatttcatggctagagttctaaggttgttcccacagcctggaagtctcttccctgacttgttccacgatcaacctctactcacccttcaaggctcagctcaaatgccccttgccccagaaaccttccacaagtcctgaaggcatcactgaaccccatttccaggatgagcccacagcactgcatacaatgagttgagcagtaattatttgtatctggtccaggttcccaatgattaactccttgagagtaggaacactatcacgttcatcttggaatcctcagtgactgacacagagcttgctgtacaagaagccctcaaaaaatgtgtactgaatgaataaaatgcatgtcctagatgtttgtatctcatagcaactcttattttcatatctgccagtgtgctgaggaatggagtggggaggctgagctcctgtctgaataaacaaatgagacagt

SEQ ID NO: 368107 - DNA, 737 bp, Homo sapiens
ccagtgttctttggagtccggggaagtttggcctttaaaaatcaaactgccatggacactgctttacccaaaattttggttcacattcttcactggattaactattggggcaaacaacgtataaccatgtaaaaccagtacgcttgtattggcatttcatggctagagttctaagtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagaaacttgcaaaaatagcacagagagagtggacttctggaatggcacggcaacaaaattccctacggcagcacccaaaggcttgaaattagccattccaagtgtgtccaaaaaactaaaggaaaccatgattaaacaagtaaaggtagaaatgatatgcatcaaatagagaagaataaaaggatcccatcaatatagggatagaactgtaagaaaatagaaattctagagttaaaaactacaataactgaaatgaaaaatccactagaggtgctcaagaatagatctgaactggcagaagaattagtgaactttata

SEQ ID NO: 368108 - DNA, 828 bp, Homo sapiens
ccagtgttctttggagtccggggaagtttggcctttaaaaatcaaactgccatggacactgctttacccaaaattttggttcacattcttcactggattaactattggggcaaacaacgtataaccatgtaaaaccagtacgcttgtattggcatttcatggctagagttctaagtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagaaacttgcaaaaatagcacagagagagtggacttctggaatggcacgagacggagtttcaccgtgttatccaggatgatctccatctcctgacctcgtgatccgcccacctcagcctcccaaagtgctgggattacaggcaacaaaattccctacggcagcacccaaaggcttgaaattagccattccaagtgtgtccaaaaaactaaaggaaaccatgattaaacaagtaaaggtagaaatgatatgcatcaaatagagaagaataaaaggatcccatcaatatagggatagaactgtaagaaaatagaaattctagagttaaaaactacaataactgaaatgaaaaatccactagaggtgctcaagaatagatctgaactggcagaagaattagtgaactttata

SEQ ID NO: 368109 - DNA, 351 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagccagtagacaagatttgactctggaggtgacgtctgagccaataggtatttggagtctggagaaaaagccatgctaataaatttctgaacttggaagtc

SEQ ID NO: 368110 - DNA, 402 bp, Homo sapiens
ccagtgttctttggagtccggggaagtttggcctttaaaaatcaaactgccatggacactgctttacccaaaattttggttcacattcttcactggattaactattggggcaaacaacgtataaccatgtaaaaccagtacgcttgtattggcatttcatggctagagttctaagtcacaagcacctcttcggcaaagcccacctccctctctcgcttgattccccggccatccttatcaaagaccttccaggtgaacaggcagccatcctcagcagcagtcagcaggaactgatcatcaaagccagtagacaagatttgactctggaggtgacgtctgagccaataggtatttggagtctggagaaaaagccatgctaataaatttctgaacttggaagtc

SEQ ID NO: 368111 - DNA, 1882 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368112 - DNA, 2013 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgaaaaaaaaaaa

SEQ ID NO: 368113 - DNA, 2732 bp, Homo sapiens
  misc_feature (24)..(24): n is a, c, g, or t
  misc_feature (1886)..(1886): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacaaaanaaaaaaaaaaaaaaaaaaaaaacaagagagcagacagacacacacaacaaaaaataaaaaaaaaagagagagacacacaaaaaataacaaagaaacacaaacatacaatgaaaacaagaagagagaagaccaaaatgataaagaacacacaaattataatcaacagaagacaaagcaggccaaaagagtatctaaaaagcagcagacagagcgaaagggggaaacaacaaggcaaaaaatggagggaaatcacttcggccacgaagagagaaacaccctaacacatcagctgggggggcaagcaaccgcaataacagtggggaaaaaaaagagaggacacaaccaacagcagaagagaatgacagagcggccctccgaaggacgggacaaagccacagacaaaaggcgacccacagcggtgcgacaataaaaagcagtagagaataaaacaaaaagacgagagggacaaaattaggagcaacagaaagcgaaaagaaacgacaaaaacaatcaggcggaccaaacacggcgggaagaaaagtagcaagatcagagtggccaaacccaagcactaacaagaagccagggagaaacactaaggagcgagaaataagcgagacgagagagagagcgcgaggacagagagacgggcagagagaaagagagcaagcgagagggaaggagggagaagagagcgaaggaagaagaggaagagaagaaggagaacaaagacaacagacgctaagacgaacagacgaccaagagagaaaaaaagcaagcggcacaaaggaaaggagcgcacgaagccagaagacagctgaaaacgacagccagagaaagacagag

SEQ ID NO: 368114 - DNA, 2163 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaattgtaagtgagcccaggtgcccgggtgaggagcaggctcagcctcccctcccactcccaaccctgccctctcccttcagttctgttcgtcctcaccctggggcagaaggcaagctgctatgtgaccagatgtggtatgtctttttctgtagaagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgaaaaaaaaaaa

SEQ ID NO: 368115 - DNA, 2032 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaattgtaagtgagcccaggtgcccgggtgaggagcaggctcagcctcccctcccactcccaaccctgccctctcccttcagttctgttcgtcctcaccctggggcagaaggcaagctgctatgtgaccagatgtggtatgtctttttctgtagaagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368116 - DNA, 1926 bp, Homo sapiens
  misc_feature (24)..(24): n is a, c, g, or t
  misc_feature (1540)..(1540): n is a, c, g, or t
  misc_feature (1550)..(1550): n is a, c, g, or t
  misc_feature (1557)..(1557): n is a, c, g, or t
  misc_feature (1574)..(1574): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaagggcccaacgggnccccaacggnaaatttntgaaaaggggaaagggngcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368117 - DNA, 1624 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368118 - DNA, 1250 bp, Homo sapiens
  misc_feature (142)..(142): n is a, c, g, or t
  misc_feature (145)..(145): n is a, c, g, or t
gttgagccacggtgtgtgcagtagtggcgcgtcctagtaacgcctgcttgcatcggccagaggccgcctctctgcgtagcgcgtttgtcgtctcgcggatacacccgcgtttcttctctgatcggctagtagggtaccgctncgntgtcgtcgcgcatgtactggtatcatacatctccccgtctctcgggattcgccagtcgtgacctccgcatgtaattccactgcatcacagtacagcagacgttgtccggatgtcgtcaccccggaaggtcttctgaaaccagggctcttgtgtcatgactacagagggccgaaagaaggccgtgcattacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368119 - DNA, 1820 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggtctctgattaactggattcttgagggagatcggaactctggacagggccaagatggaggagccataggccaccgacataggaaggggccagggcaaagacgggataaaccagaaagttggcggtcgggtcgcaacaacacagcggccccaaggtcgcacccctggcagcacgcagtaccgaagtacttacaacaggaggcagacaaccattgcagacgccacaagacgggaacaagcataatcacacccgcacagcagacaatcaatctagaccccagacgcgtcacacacacacgactacacgacaaccgaccagtgcgatggcaatacaacaaaaaaagagcacagagcacgtcatagacgaaaggaggaccgatgtcctc

SEQ ID NO: 368120 - DNA, 1067 bp, Homo sapiens
  misc_feature (195)..(195): n is a, c, g, or t
cgcttcgcgtcttaccccgctccatcagctcaaagtccctaccaagcgaccactgattattttgcggaaatggccaaatctgatctgcagatgcgaagattcgacagaagctgcagactaaacaggctccatggagaggtctgaaaaagctaagcaactgcgagcacttaggaaatacgggaagaaggtgcaaanggaggtcttcagaagacggcagcggggtcagattttgagagtccttctgagcttggataactcatgattggcggtgaaaaggaacgtaaggcctcctccttcacctcattacacattttgtcctacgattctcagcctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368121 - DNA, 1043 bp, Homo sapiens
gcgtgccttgtcctggtctcgtgagttctttatatgcttctcctcatttttgcctgaaagcacgaagaacacacattaaagcttttcctccttgaacagcttgtggcctagatgagaatgtagctattccaggcatagtctggattatttgatgaaatatctcctccatgtcattttctgacacggtctacattgttgccgttctttatggtaatctggactaggtgttttttcttaatccactgctgaatctgtttagtctttgtgtccaaatcatgttgtccaatattggaagacaaaagcagttcctttctcagggttggtccagttttgggtttcgccttccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368122 - DNA, 1344 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgaaaaaaaaaaa

SEQ ID NO: 368123 - DNA, 151 bp, Homo sapiens
tcggcaaagcccacctccctctctcgcttgattccccggccatccttatcaaagaccttccaggtgaacaggcagccatcctcagcagcagtcagcaggaactgatcatcaaaggtaagcaacatctgaagagaaaaagggtcatggccag

SEQ ID NO: 368124 - DNA, 1882 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagcccactcaccccatcaatagcctctttggaatgtttgattccattcagaagcagttaatactggctgttcaggtttaagccttgatgccctctgttggtgtgatgatgtaaacatttgctttccattaaattatattttaatcagttaaggaa

SEQ ID NO: 368125 - DNA, 1755 bp, Homo sapiens
  misc_feature (24)..(24): n is a, c, g, or t
  misc_feature (1699)..(1700): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaattagagnntggaaagaacaagagagtgagaagaccctaatgcatcttgttcaagaccgaaagg

SEQ ID NO: 368126 - DNA, 2804 bp, Homo sapiens
  misc_feature (24)..(24): n is a, c, g, or t
  misc_feature (1958)..(1958): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaatttctgttcgtcctcaccctggggcagaaggcaagctgctatgtgaccagatgtggtatgtctttttctgtagaagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacaaaanaaaaaaaaaaaaaaaaaaaaaacaagagagcagacagacacacacaacaaaaaataaaaaaaaaagagagagacacacaaaaaataacaaagaaacacaaacatacaatgaaaacaagaagagagaagaccaaaatgataaagaacacacaaattataatcaacagaagacaaagcaggccaaaagagtatctaaaaagcagcagacagagcgaaagggggaaacaacaaggcaaaaaatggagggaaatcacttcggccacgaagagagaaacaccctaacacatcagctgggggggcaagcaaccgcaataacagtggggaaaaaaaagagaggacacaaccaacagcagaagagaatgacagagcggccctccgaaggacgggacaaagccacagacaaaaggcgacccacagcggtgcgacaataaaaagcagtagagaataaaacaaaaagacgagagggacaaaattaggagcaacagaaagcgaaaagaaacgacaaaaacaatcaggcggaccaaacacggcgggaagaaaagtagcaagatcagagtggccaaacccaagcactaacaagaagccagggagaaacactaaggagcgagaaataagcgagacgagagagagagcgcgaggacagagagacgggcagagagaaagagagcaagcgagagggaaggagggagaagagagcgaaggaagaagaggaagagaagaaggagaacaaagacaacagacgctaagacgaacagacgaccaagagagaaaaaaagcaagcggcacaaaggaaaggagcgcacgaagccagaagacagctgaaaacgacagccagagaaagacagag

SEQ ID NO: 368127 - DNA, 2118 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgtggtgagcgtgggcacagggtcgggggtactcggacatgggatgcgcttcaggcgctgttgggcttgggagaccgattcttgtcccaggaaagatgcaccctgcgcctcgccaagagggtcaattacctgtctgggtattggggattagcactttgtcccttcgcctaacagcctgtgcttgggaaagacaaactcagagttcccttcttgtgagctcagtgtctggatttcctagaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368128 - DNA, 1952 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttgtatgtttgttttcaaatgttggagaagttgaggatccttgtgcaggagagtgggaaagaggggaaattactatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368129 - DNA, 2188 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgtggtgagcgtgggcacagggtcgggggtactcggacatgggatgcgcttcaggcgctgttgggcttgggagaccgattcttgtcccaggaaagatgcaccctgcgcctcgccaagagggtcaattacctgtctgggtattggggattagcactttgtcccttcgcctaacagcctgtgcttgggaaagacaaactcagagttcccttcttgtgagctcagtgtctggatttcctagaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttgtatgtttgttttcaaatgttggagaagttgaggatccttgtgcaggagagtgggaaagaggggaaattactatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacaca

SEQ ID NO: 368130 - DNA, 1433 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccaggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttgtatgtttgttttcaaatgttggagaagttgaggatccttgtgcaggagagtgggaaagaggggaaattagtaagtctgcactcagaataagcctaggagtagagagagcggcttcttttgactaagaatagctaggagattcttcctgtttgagagaagagctctttggtccacggtcacgatccaaaatccactttatgggctaatttgaaatattcatgttaaaactttttgtgcatgcttcagttattaggaaaacaaacaaacaaacattgcttatgggatg

SEQ ID NO: 368131 - DNA, 612 bp, Homo sapiens
  misc_feature (24)..(24): n is a, c, g, or t
ggtttccggggagacacttgactncgtggtctgaaaatgctgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagaaacttgcaaaaatagcacagagagagtggacttctggaatggcacggcaacaaaattccctacggcagcacccaaaggcttgaaattagccattccaagtgtgtccaaaaaactaaaggaaaccatgattaaacaagtaaagccagtagacaagatttgactctggaggtgacgtctgagccaataggtatttggagtctggagaaaaagccatgctaataaatttctgaacttggaagtc

SEQ ID NO: 368132 - DNA, 606 bp, Homo sapiens
tgagactctgtctcaaaaaaaaaaaaaaagaacccaaacttttggtgttcagccatgttcccatgctcactcccagggtggtgactctgggaaggtctcagcctccttgtctgcccagttagaatgatctgatgcccctgctaccatcagacttgataagtttcccaaagactctttgcaagaagcactgttctggagggtggaggagagactaattgttcttgctctcctggccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaagttgtctgcccagttagaatgatctgatgcccctgctaccatcagacttgataagtttcccaaagactctttgcaagaagcactgttctggagggtggaggagagactaattgttcttgctctcctggccagagtgggaagctttggggtgccggtttgtgggtgcagtgcccat

SEQ ID NO: 368133 - DNA, 2403 bp, Homo sapiens
  misc_feature (2329)..(2329): n is a, c, g, or t
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaaaaaaaaaacaaaaaaaaaaaaaaaaaaaaaaacaaaaaagagaggcggggggcgcgcgctgcagagaaatatacccccgccggggggggccccataatagacgcggctcccccccgactctttcgtgcaacaagaggggcgcccccccatagaaggggcggcgcgattaataagaacccgagagagcggcggggcgcccgtcgctttttcatcccaagggcgcgcgacaggggcgagtggggagaagacaccgggtgctgtccttgctgagcgagaacatctcttgtgtgggcgaggacggaggcccaccctcatacgctctgccgaggggggaggggcgagccacaatatcgattgagcgggaagacaacctaacttcctcagagaagagaagagattatataacgaacgatcttaatggagagggagaagatattatatagagaaattataatagaggggagatgtatattaatgggtgtgcgttcataacaaaaagagggagagagaaaaatatttggaccggagaggcgatgatgagagaagattgtatgaggcgcaatcagagcaagagaaatgatatgctatagattaatgncaggaaaaactatttttttttataaacgagggagggggcgatccattctatagattaattaaatgatgaagcga

SEQ ID NO: 368134 - DNA, 1828 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggtgagcaaggcagggggaggggcggggcctctgggctgatggtgggtggccaggggggcaggatcccgggtccagcccctgtgcctccctcttcccgcatgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368135 - DNA, 1661 bp, Homo sapiens
tgagactctgtctcaaaaaaaaaaaaaaagaacccaaacttttggtgttcagccatgttcccatgctcactcccagggtggtgactctgggaaggtctcagcctccttgtctgcccagttagaatgatctgatgcccctgctaccatcagacttgataagtttcccaaagactctttgcaagaagcactgttctggagggtggaggagagactaattgttcttgctctcctggccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368136 - DNA, 1651 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368137 - DNA, 1799 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataaa

SEQ ID NO: 368138 - DNA, 2170 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggtgagcaaggcagggggaggggcggggcctctgggctgatggtgggtggccaggggggcaggatcccgggtccagcccctgtgcctccctcttcccgcatgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368139 - DNA, 1027 bp, Homo sapiens
gggactcatagagaccgtgagggagagagcgaaggcgagacagagatggagtattaccgagggacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368140 - DNA, 1337 bp, Homo sapiens
tgtgtgtatatgtgtgtgcctatgagagtgtgtatgtgtgtgagtgtgactgagagtgtgctagtgtatgtgtgtcactgaaagggtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368141 - DNA, 2509 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatggtggttcaccatgcccagcactggccaacatggtgaaaccccatctctactaagaatacaaaatttagctgggtgtgtggtggcaggtgcctgtaatcccagctactcaggagttctgaggccagagaatcacttgaacccaggaggcggaggctgcagtgagccaagatcacgccagtgcactccagcctgggcaacaagagcgaaactccatctcaaaaaaaaaaaaaaaaaaaaggaagggggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataaa

SEQ ID NO: 368142 - DNA, 1775 bp, Homo sapiens
tgtgtgtatatgtgtgtgcctatgagagtgtgtatgtgtgtgagtgtgactgagagtgtgctagtgtatgtgtgtcactgaaagggtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatggtggttcaccatgcccagcactggccaacatggtgaaaccccatctctactaagaatacaaaatttagctgggtgtgtggtggcaggtgcctgtaatcccagctactcaggagttctgaggccagagaatcacttgaacccaggaggcggaggctgcagtgagccaagatcacgccagtgcactccagcctgggcaacaagagcgaaactccatctcaaaaaaaaaaaaaaaaaaaaggaagggggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataaa

SEQ ID NO: 368143 - DNA, 1547 bp, Homo sapiens
gacgccatcccggccagaaaagccctggccagtggcgggcgcgacactatccgtgcggccaggcggagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368144 - DNA, 953 bp, Homo sapiens
  misc_feature (894)..(895): n is a, c, g, or t
  misc_feature (899)..(899): n is a, c, g, or t
  misc_feature (904)..(904): n is a, c, g, or t
  misc_feature (918)..(918): n is a, c, g, or t
gacgccatcccggccagaaaagccctggccagtggcgggcgcgacactatccgtgcggccaggcggagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggcaagacctatcttnntggncaagnattcacgtcggagnctcaatctaagacgggaacagctgtgccaaaaaac

SEQ ID NO: 368145 - DNA, 1729 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368146 - DNA, 2119 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataaa

SEQ ID NO: 368147 - DNA, 1673 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagatgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368148 - DNA, 2071 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368149 - DNA, 1534 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368150 - DNA, 2163 bp, Homo sapiens
  misc_feature (2089)..(2089): n is a, c, g, or t
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacagcagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaaaaaaaaaacaaaaaaaaaaaaaaaaaaaaaaacaaaaaagagaggcggggggcgcgcgctgcagagaaatatacccccgccggggggggccccataatagacgcggctcccccccgactctttcgtgcaacaagaggggcgcccccccatagaaggggcggcgcgattaataagaacccgagagagcggcggggcgcccgtcgctttttcatcccaagggcgcgcgacaggggcgagtggggagaagacaccgggtgctgtccttgctgagcgagaacatctcttgtgtgggcgaggacggaggcccaccctcatacgctctgccgaggggggaggggcgagccacaatatcgattgagcgggaagacaacctaacttcctcagagaagagaagagattatataacgaacgatcttaatggagagggagaagatattatatagagaaattataatagaggggagatgtatattaatgggtgtgcgttcataacaaaaagagggagagagaaaaatatttggaccggagaggcgatgatgagagaagattgtatgaggcgcaatcagagcaagagaaatgatatgctatagattaatgncaggaaaaactatttttttttataaacgagggagggggcgatccattctatagattaattaaatgatgaagcga

SEQ ID NO: 368151 - DNA, 2015 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagatgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368152 - DNA, 1321 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacagcaggcctaggtcctcccacacctgccccctaataaagtgggcgcgagagg

SEQ ID NO: 368153 - DNA, 2039 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagacccctgtgcctccctcttcccgcatgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 368154 - DNA, 1952 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatggtggttcaccatgcccagcactggccaacatggtgaaaccccatctctactaagaatacaaaatttagctgggtgtgtggtggcaggtgcctgtaatcccagctactcaggagttctgaggccagagaatcacttgaacccaggaggcggaggctgcagtgagccaagatcacgccagtgcactccagcctgggcaacaagagcgaaactccatctcaaaaaaaaaaaaaaaaaaaaggaagggggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcaggtacggcccatccccttcc

SEQ ID NO: 368155 - DNA, 413 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtgagtgggacctcggggactccggtcctcctagcctccaaaggagagagtgggggcgccagacctgcctcgggccaccctgctgggaatcgccctccaggaagcaat

SEQ ID NO: 368156 - DNA, 418 bp, Homo sapiens
  misc_feature (375)..(375): n is a, c, g, or t
tgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcccggcctaattttttttttttttttgagatggagtcttgctctgttgcccaggctgcagtacagtgatccaagatcataccnctacactccaggctgtgtgacacaatgagactgtgtcttaaaa

SEQ ID NO: 368157 - DNA, 410 bp, Homo sapiens
agctgtacctcatttaaatctttgggtttactgctcatcttactatatcaggtaagcatgctgctttgtgtctgcccacaagctggactcagggattacagaatgagtgtggctctggtggacacagggaagcatggagataaagaagttcattggtttctctaaatctgtttttcccagaacagtttggcagcacagtgaaaaccaactgcagaatcctcatttcctaggaaacgtctatcaagccacagatccctcaacttgtcaccagcccatagtctgtcaaggcataagccagttgtactcggaagacacgctgcatccttgtgatgccttgccttgtatgggatttattatcaactgttacccattgtttaggggtttttcccccctctctcttcctgacatcc

SEQ ID NO: 368158 - DNA, 3908 bp, Homo sapiens
ctaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacagctcacaacccagtgaggaaacctgagagtggaggctcagaccaccagctccatctccctgagctgggaggtccccgatggcacagacccacagaactcgacctactgcgtacgagtgcactggagatggtggcagaacagagactcgaaacacaacagacaccagagtcaccagtggatggccttggacccgggtcattgtatacgtgttctgtgtgggtggagaaagacggagtaaatagctcctcgtggagattggtaactagtaccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccagaaaaagtt

SEQ ID NO: 368159 - DNA, 3419 bp, Homo sapiens
ctaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacagctcacaacccagtgaggaaacctgagagtggaggctcagaccaccagctccatctccctgagctgggaggtccccgatggcacagacccacagaactcgacctactgcgtacgagtgcactggagatggtggcagaacagagactcgaaacacaacagacaccagagtcaccagtggatggccttggacccgggtcattgtatacgtgttctgtgtgggtggagaaagacggagtaaatagctcctcgtggagattggtaactagtaccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccagaaaaagtt

SEQ ID NO: 368160 - DNA, 1144 bp, Homo sapiens
ctaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacaggtgagaggcagtcgccatttgttttgctcttacttgtttaaggggcagtaggcaggagaacgtagcggatttctattccatagtccctctgggccacattgagccaggtactcatgtccacatcctggggcagtctcagctcaggagatgaagaaggaatgaatgtccatggtacctccagctgctaagctggggccggtctgtgtctaggactctctagaatgtaccttcctgcaccaagaggaatgtgtaggggccaaggcatgttacctgagctttcaaggaattagatactgtgagtggggacactctgaccctctgactcttcttctagtccccagctgcgtcacatattgaggatggaaactcagatcatcagctccatgatcctgatgtggagagctccctctggctagatctccattgtccgatatggtagccaccagccacacatggctatgcgtcttagggaaactctggacag

SEQ ID NO: 368161 - DNA, 3773 bp, Homo sapiens
ctaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacagctcacaacccagtgaggaaacctgagagtggaggctcagaccaccagctccatctccctgagctgggaggtccccgatggcacagacccacagaactcgacctactgcgtacgagtgcactggagatggtggcagaacagagactcgaaacacaacagacaccagagtcaccagtggatggccttggacccgggtcattgtatacgtgttctgtgtgggtggagaaagacggagtaaatagctcctcgtggagattggtaactagtaccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccgtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccagaaaaagtt

SEQ ID NO: 368162 - DNA, 953 bp, Homo sapiens
gggtgcagccttgccagagaagcagagaagcgtctgtggctgggtgggtgatattgaaagattcctttcaccagggtggaagccaggatctgaggcgtgatggaatgtggacagtgaggcagtgacagcgccacaaggcaggagtcatctccaggcacgtccttggcctggagcccatagggacaagctcctggtggtgcctcactttgccatcctctctaagccgcagaccttgaatggaatcagtgctcaagagtctaattgggcccactctgaggatgcctgcgggaatatcagcttttaccgcaccacactgcactttacagtgtgggagggcctgccccacgcaccacctcacctgtactgcggttctcaaacttcaccctacagccattctgttgtaggtgatctcaggggcagtttgagaaacagtggctcagggtctcacagcagccctctgagataggttggttgctattgtcccgattttttctcatcaagaaactgaggctcaggtgagctaaggaatgtgcccagggccactgtttataagaagtagcctcaagccttgctcatggttactgccctgacagggatctaggaaagagtgagcaggagaatgggatgaggcaggaccctccgccccagccctgctttctctgcccagacacctcctgccttgcagacccaaccccaccccagatggtttcctttccagtcacccagctgctagttctccaggttcctggtctcactccaggttcctcctgttagagaagcatcccagagacattcattcctggcaaggacacaggcctgcggacctgaaggtcaggtgggcagagccacataagatctggtgccccatcctccatttaaaaaattatactttccaacggcattggtataaaggtgaatatattaatatcatatattaaaacattttctttgaa

SEQ ID NO: 368163 - DNA, 500 bp, Homo sapiens
tgcccagggatggtgaggtcctggctggggcaccccaggggctggtgcagattgaggggcagcagggctgagagccgcaacctggctgggttcctggcctgtgaaaagggagctgtgtgttccttccttacctgcttgtaatagaaagctgctccttcgattgagctgtttccttcttttgccctgagctatgaggagtagattagatgaaaaaattatcaagcctcctcgtctagaataaatattcttgaaatggagcaagttataaataagcaagcagcaatatcctgtgttatgaatatataatttctatctttaatagctgactaggccccagggactgtctgaaaatggcctgtctggccctgatattttatatatttcttaaaaggcacccaaacttttgtttcttagcccttggacagttaagtcttagggggaaataatgagagttgaaagtctcattgagcaaatgcaccaagcgcaggtacttggtttac

SEQ ID NO: 368164 - DNA, 825 bp, Homo sapiens
tgtcagcacgggagcctctgcttggcagagctttaaggtgaaagcacagagcaaccgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaa

SEQ ID NO: 368165 - DNA, 647 bp, Homo sapiens
gacagagcgagacaccatctcaaaaataataagaaagaagacgggattggagccaaattacttgaacccaagtcccagctctactcctcagcactatgttattggccatattttctcatcagtaaaattggttaatactagctctgcttatccagagaataaattaaatgatctatttgagagggatttatgtactatacacacaatagaagcctggctctgatttcctcttgagtgtatcctggctaggctgaagtagaagggaaattagagggagaagctgtctggccttccttgggaataactattccttcctgccctcagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368166 - DNA, 432 bp, Homo sapiens
gcaccccctcctgcgctgtccatggataagatctcccccagccccgaggccgggaacgatcctgtcctccagtgacctccttttccctccccttacctcctccttaccagagctttaaggtgaaagcacagagcaaccagcagaggtggcggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggaaaaaaaaagtcgtatcgatgt

SEQ ID NO: 368167 - DNA, 2515 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368168 - DNA, 2759 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaa

SEQ ID NO: 368169 - DNA, 2976 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaaaaaaaaaaaaaaaaaaaaaaaaaataaaaaaacagaagagaaataatggggggggggaaaaggagggtactggaatggggcccatggggcataaggtggtatcattggaccagagttttctctggtaccaaaggggggaagatttctggcgggtctacacttataagagagtcggtataaaattgcagaaaagccagggttacgctgctttatacgg

SEQ ID NO: 368170 - DNA, 3147 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaaaaaaaaaaaaaaaaaaaaaaaaacaaaaaaaaaacacttgtggggtgcggcgcgcgggcctctgcggccccccgagaaaaagggtttttttaagaccccaatctctcggttggggcggcggggggcgcccaagatgaggtctaggggggacacgtgtggccaacaaggcgggggtccccaaaagagaccactccgggcgcacagggcaacaacaggggcggtgggattctcctcccccaaaattaaaaaaaacgcgccggggggggaacaccgggaggggttcttttagaacacaacttccaagaaggggagctctgaagaggggcacaagcgggggcctacatcaaccaaggggcctccaaaggagggcacgatataaaaatacgcg

SEQ ID NO: 368171 - DNA, 2903 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggaaaaaaaaaaaaaaaaaaaaaaacaaaaaaaaaacacttgtggggtgcggcgcgcgggcctctgcggccccccgagaaaaagggtttttttaagaccccaatctctcggttggggcggcggggggcgcccaagatgaggtctaggggggacacgtgtggccaacaaggcgggggtccccaaaagagaccactccgggcgcacagggcaacaacaggggcggtgggattctcctcccccaaaattaaaaaaaacgcgccggggggggaacaccgggaggggttcttttagaacacaacttccaagaaggggagctctgaagaggggcacaagcgggggcctacatcaaccaaggggcctccaaaggagggcacgatataaaaatacgcg

SEQ ID NO: 368172 - DNA, 2537 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggaaaaaaaaagtcgtatcgatgt

SEQ ID NO: 368173 - DNA, 2471 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtgtatcagctaagctcctctaga

SEQ ID NO: 368174 - DNA, 2361 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368175 - DNA, 2871 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctggtaaggaggaggtaaggggagggaaaaggaggtcactggaggacaggatcgttcccggcctcggggctgggggagatcttatccatggacagcgcaggagggggtgccctattttctgggttttgacttttgtcccttcccccaactccgctacagccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368176 - DNA, 2624 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368177 - DNA, 2453 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368178 - DNA, 752 bp, Homo sapiens
aggcggcacttactctgcagccctcccagaggttccaggtcaggacagggaaggccggagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368179 - DNA, 2561 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368180 - DNA, 581 bp, Homo sapiens
tgtcagcacgggagcctctgcttggcagagctttaaggtgaaagcacagagcaaccgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368181 - DNA, 2932 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggaaaaaaaaaaaaaaaaaaaaaaaataaaaaaacagaagagaaataatggggggggggaaaaggagggtactggaatggggcccatggggcataaggtggtatcattggaccagagttttctctggtaccaaaggggggaagatttctggcgggtctacacttataagagagtcggtataaaattgcagaaaagccagggttacgctgctttatacgg

SEQ ID NO: 368182 - DNA, 2430 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368183 - DNA, 3342 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggat

SEQ ID NO: 368184 - DNA, 2377 bp, Homo sapiens
  misc_feature (2195)..(2195): n is a, c, g, or t
  misc_feature (2377)..(2377): n is a, c, g, or t
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagtgncgtcacgtttgaggacaagttattggagtcgaaggtggggtgggggccgaatcgggttggtcacgcgcgagatgggaaggccgaagggggaagggctaggttcccgttggtggacaccagaaagagggggggggggcgcctgggggaagaacagacaacgggcggggggcgggaggcggcgn

SEQ ID NO: 368185 - DNA, 3057 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggat

SEQ ID NO: 368186 - DNA, 646 bp, Homo sapiens
ggcacgaggccccagggccgccacctctgctggttgccctgggggaggccaggcctcccggcacccgcaagcatggagcgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368187 - DNA, 3079 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggacccacaccccaccaccccccccccccacccccacaccacacccacacgggggcgcgccacaaaacaaccccccaggcggccccacaatccccccgccccacttatgcacaagcgcgcccacaaacgcggcgaacaaacggcgacccgccgctaacaccgcgaccgaccaccgccagcagcatcaaagaacccccagcgggcgcactcggccccaacagccggaacacaaatccggccacctgccggcgcgtacccacatcaacagccgcccgcccgctgtcacccccgcccacgaagacgccacagcacgccacctcctcgcaccgctctgaccctcgcaaccgtgctccctgacgacgtcacgtcgccagacgtggtggactggacgctcgcccgccgctgggccgcagcgcgccatggctcgcgcgcggccgagccctactgccttcgtccggacctagctcggccgtgacctcggccgcccataggcgtaagtcccacgtcgcacacagatgagatagcagaccgacaccacacaacgcccaccacaccacacccccacg

SEQ ID NO: 368188 - DNA, 2592 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttctgcctgggtttaaggcccaagggaaaaaagggaaaagggggttggggcctttacctttccccaatggccttccttaaaagttttttcccccggggcttaaaacgtaacgcccccttgaaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368189 - DNA, 3188 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggat

SEQ ID NO: 368190 - DNA, 2715 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368191 - DNA, 2674 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtaaaaaaaaaacaatccaaaaaaaacgggggcggttaaaagaatcctggggggccaagtttagggaaccaaggttcttggaaagtgggccctataggggggatataaaaggaggaggacgggttaaaaaggtggggtgggaaacggattgggatttgga

SEQ ID NO: 368192 - DNA, 2732 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggaaaaaaaaaaaaaaaaaaaaaaaataaaaaaacagaagagaaataatggggggggggaaaaggagggtactggaatggggcccatggggcataaggtggtatcattggaccagagttttctctggtaccaaaggggggaagatttctggcgggtctacacttataagagagtcggtataaaattgcagaaaagccagggttacgctgctttatacgg

SEQ ID NO: 368193 - DNA, 3142 bp, Homo sapiens
taccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggat

SEQ ID NO: 368194 - DNA, 2081 bp, Homo sapiens
  misc_feature (86)..(86): n is a, c, g, or t
ggtggtgtgagacgttgtgtagtgtgttgggtgggtggtggtgctgtggggtgtgtgtgtgggtgttggggcgagttgttttgtanaaaaaaaatataacaaaaatgaggcaggaggattgtttcccgagagcgctgacaagcaccgattgcccctcgtgctgcgcttagatttttgagctgtccgcgagcatccccggggagccccatcgagttacagttacccaagtgaaccgcagattttgcctgggtgacattaaggcaaacccaggttccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgg

SEQ ID NO: 368195 - DNA, 453 bp, Homo sapiens
cttaacaaatctgtccattgttcagagggttgattttctttctatttaatgcttttgcaacccaggacaacagttagcagccatcactgcctgggattcctcagctaccaatattacctctcatattacagtagtaaccccgtttggtgggtaataggctgttcttcctcttcttttataattttatttaagaaatagtttataaaagtatgctccatgtgcatgttgcttttactttatgtaaattgctacataaaatttgattgcttgcatttttataaattatagttacagagtttgttatgattcatagatctgtttatgaacttgaatttaaatttgcaattcagtaaaagatagggtgagcaaataaaggtatgagtaggcctattttagacttggaaattgatgtgtgctctgaattttcagattaaaagtgattaatgaacatta

SEQ ID NO: 368196 - DNA, 486 bp, Homo sapiens
actatcataatttacttgtggcttaaattgttccagctttagccattgggctccttttgagattggctcctgtatccttttgatatatcccaccttttcttctgattttttactttgtctttcttgtcttcagactcagccatttcttcaaggaaccctggttccttttggagaatggtatttggaaaccaagatctggatgttacatgtgcacattactattgtattgttgcttctaggctctcactggacagagctaagaaaaatatgtgtacatactaacccatgagaatagacatactcatgtttatttatttatttatttatttatttaatttttgcttttgagacagggtctggctctctttcctatgctgtagtgcagtggcatgatcatagctcactgcagcctcaacctcctgggttcaagccatcttcctgcctcagcctcccaagtagctgggactatatgcatgtgccactgta

SEQ ID NO: 368197 - DNA, 164 bp, Homo sapiens
caaaagtcttaactcattccaaatgtaaaaacttcaaagtctcatctgagacaaggctacattctcttctgcctatgagtccctgaattcaaaagggatttcttttctttcaaggtacaatgatggtacaggtattgggtaagctttctcaatccaaagggaaa

SEQ ID NO: 368198 - DNA, 461 bp, Homo sapiens
gtctcctagaagaattggtgcaaaacttgagtctcaaaggatgagctgggtgaggagttgggcacagtattctgggcagtgggaacatcatggacagaagcctgaatgcagcggagagactgactcacttgtgggcatgaaggagatcagcatgactggattggagctcacttcctggtgttttcacctcattgcatccctggttggtttctgttgcttgcaatgaaagaacccttacaaatgcaataatgcagaagtaacaatgaagatgacactgattcacacaagatttaatttgttacatgagtaaataaacaaagcaaaatgaacagaatttactatactgcatccctgctgggagtatgttgagctatctggcctggaaggcctttgtgacctgttgaaagaatatacatggatttacttcaggagaaaaataaagtgttattttaaaaatggat

SEQ ID NO: 368199 - DNA, 2786 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttac

SEQ ID NO: 368200 - DNA, 332 bp, Homo sapiens
tttgtggaagacttccataatgacattcagcggtgtgcaacatacctagattattcctgtcgtaaataatagcaactgccatttattgagtggtcactatgtgccaggcactgtatggtcttaatgttaagctgtctcattttgtctttacaacaacaaccctagaaggtaaatggtgtcatttcatttttgcagatgaagaaactgaggcccggagacacagttaagtgtaggagctaagacctcaacccaggtctctctgactcttaactacttattagcaatcaaggttaataaaagctacctcctgacaaaccagagatggccttaca

SEQ ID NO: 368201 - DNA, 4789 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368202 - DNA, 4950 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368203 - DNA, 6197 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggtaggagaccccctagaagcagggaacatggccaaacagactactacccacagcacactgctcagaggaatatatttcaggctgtagccaaatcatctgcccaggatttagggcaaacaattattttgctatgttgactccccagttaaagtgtacgtaactacatgtctatacatacactgcctcacctctttttcaaaggacagtattaaaatagataggcaggacacaaaggaaacaggaaatttaagaatcagatataacttggagatgcactgccatacaattattaattcatttaacaatatttattgagccgttattcttgggaatctctaaaagacagattctgagatttttgttttgggccatcagtgcccaaactgtttagctgcatgaatttcctctagctagctgtttcagctttatgagataagaatccctcccttttgccttgaaactacatgccatatcagtctccctgtattcatctccatttgtcacccccatccattgctgtagttggtgtttccagggcataagactctcagattccacagggcaggttgatgatctcctgggtttcaaccttgtccgtgtggcaccatatagtcttttccatacggcctcttcctgcttttgctgtgtcagaagtttgtcttctgctgcttgtcccctcccatctttttgttgatgatggtggtttttgctttttattcctttactattatttgaactgagtactcaaagaagaggggaggaatgggtctcgatcttccaaagaagatcccatacatcttctaattgttctacatgttaactcttccaggctatcagacccctaatattattctagatattcagcctggaggcaatcatgtaattgaggattctcacaaaaaggtatgttatcaaggccctctcagtggacagattcccgaactagatacatgttgttttcacattttcagtggttgcagcaggtttatgacaaagccacttcacaaatgtcctatctatgggtgagacccaggaggggagggagggacactgtgtcaatcaagagaaatgtctctctcttgtacttgatacgtgagctctgttaaagaaaataatttaatcttaattgttggaagccttctgcctctctctcgaatgaaagtattcttgccataaattgctgacttcacggttaggtaaagatggatagataaagagaagcttaaacagtggcattttactacaaaggccttctatttaatttttttaatgtgtttcttttagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368204 - DNA, 4994 bp, Homo sapiens
atgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368205 - DNA, 4933 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatatatacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368206 - DNA, 4908 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccgtacgttctggacaagcccctggatcaatttttcagcacactaattagcacttatgttctattttatttcattgtttgacagtcttttatacttctgagagatctaatcacttcttgaaagaatgtcaaggagctccattaaacagcaatctactgggggtattt

SEQ ID NO: 368207 - DNA, 4099 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtga

SEQ ID NO: 368208 - DNA, 1564 bp, Homo sapiens
  misc_feature (4)..(4): n is a, c, g, or t
gaanagaatagggcacaggtatattgaaatctttaagagcagtagagctgaagttagagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368209 - DNA, 866 bp, Homo sapiens
ccttccaacatctcatggcggttgcagaaccagatgctttaagctgcttctcattgtgggatcactcaacacaaaataaaacagaccccccaaaacaaaggcttccggtctcccgcaattccaacaaaaaccttgtcatccagaactttgaaatatcctaatccaattgtcttccattttaagttttcttttcttttctttttctgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368210 - DNA, 764 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatacgagcatcctgctcctgtggcatggggcccggtggcagtcagctggacgatgacctcggctgatgcttgagaaggggaaagcggctgtcccaggctaaagacataagaggtgcgccgcgttgagtgcaggcttcctggcctacatgaatggttcccttggccggacctgcaagccggcccgtatgccgggcttattgtgggcaccgtgcatgccggcaccggaaggcgcatctagatgggcatcgagccaggtgttctactacagtgggccttaggatgagaaa

SEQ ID NO: 368211 - DNA, 732 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgtatgtatggggggtgtgctggtctctttccttctcccctttctccccccgcccagccacccacccctcagtccccaggtcctcgctttttgactaatgtcccggcactgcgtgcgtgtcacctggtccctctccctgttgcattcagatcgcctcatccctggggtggagagttgcacggggtaaacgaataggttctcctgagaacacccatttatctaccccacccccatcctagccttgcatactgtcttcttggggatgaaagatggatggataaaggctgtgggaacgtggtgatgt

SEQ ID NO: 368212 - DNA, 577 bp, Homo sapiens
tgtttcctccagtctgttctcctgtgcaattgttgttactgcatgtacggaattctgtatctatcttccatgtatcccgattttttcttatgctcttaattctttgtctttttcagtacgttctggacaagcccctggatcaatttttcagcacactaattagcacttatgttctattttatttcattgtttgacagtcttttatacttctgagagatctaatcacttcttgaaagaatgtcaaggagctccattaaacagcaatctactgggggtatttatacttatatttaagtcttatgtttgctataattttctctgctttctacagtgttctgttaggaatggtgtctcccttttatggccttggtttttctcagatgctgtgtgattcttgatctgtttgcttttgtgttttgaccttccttgtttgcctgtctttggttgcctgcctctcataatgggaagccaagttggatgtgggtctgacttgtctttgggacattgggatgtagggttcttttcctacttgaaggtgataagctttctagattcccaccttttttctcctggtgtc

SEQ ID NO: 368213 - DNA, 4987 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368214 - DNA, 4843 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368215 - DNA, 4934 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttactgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368216 - DNA, 5299 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcatgaagaaactgaggcccggagacacagttaagtgtaggagctaagacctcaacccagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368217 - DNA, 4933 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatattatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368218 - DNA, 3281 bp, Homo sapiens
ttccactaaaacttttttgcccttcaatttcagaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctga

SEQ ID NO: 368219 - DNA, 2096 bp, Homo sapiens
accattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggccccctttttggatgttttcaaccccatgatgggccctacccttcctttgaccttaaaaaaattaaaagaatggggggatccttcctttgatgaaaaacccaaaaactatccaactcctgagcccaccactttatatga

SEQ ID NO: 368220 - DNA, 420 bp, Homo sapiens
agaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggtgagtacgctctgtctctactgtttatagaatgggggaggtgtgaagccataggctactctaagaaaaatgtttttgggctggcacagcggctcatgcctgtaatcccagcacttcgggaaactgaggtgggcagattgcttaccaggagctcgagaccagcctgggcaacatggcgagaccctgtctctgcaagaaatt

SEQ ID NO: 368221 - DNA, 1846 bp, Homo sapiens
gaaaaaaagaaacagttttccagtgaggcttgtcagggggaagactgatcgccggcaggccggctcggaccatgagcacagttccaagaatgcagggatgaggaggagccgggctgggctgttgagtccaggctgagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaaggtttccacatgttggcggatgcagtggaagcttctcttgagatctttgccacactgttcaacatgtttgaccactctgtcctaaaaacgctttcttcttaaagcactttctcctcctggcttctgtgtgtcttactctccttgagttccctctgcctctgtggccagtccttcctcacctctcttgctggcaggttaacagtctccacttcaatagcccaaggctcagaaagactgagtaatgcgtctaacctcctctagctgataaagaaccaaggctcagaaagactgaataacgtgtctaacctcctctagctgataaagaagagaacagggatttaaacccagggacggaaactcttctcggttccctataccatattcctgtcttcagggaactgagagcatttagttgcattaaaacaaataaaaaaacaaacaaacaaaaaacctgcaggtatcttgggctctggaaggacatacaggtcagggtgaaaagtatgcttggtccaagcatcttttttcttttaacacatgaagtatgtgtcttattattttaaaagacattgagaaaaaggaacattcaacattctcttggttatagatactggagtattaacaaagtgaaaagagaaaaactaaaatttgttggctctgacttactagttttagtaatttataagaacagctttccatttgtgcctttcatacatccactgagtcatgaggtttcatcaaatgtttctttttttcttttctttctttctttcttttttttttttttttaagacagagtctttgctctgtcgcccaggctggagtgcaggggatgatctctgctcactggaacctctgcctcctggattcaagtgattctcccacctcagtctcccaagtagctggaactgtaggcatgtgccatatgcccggctaatttttgtatttttagtagagacagggtttcaccatgttggccaggctggtctcaaactcctaacctcaagtgatctgcctgcttcggcctcccaaagtgctgggattataggcgtgaaccactgcgcccagcccagatgtttcttagattgactttgctgtgtttcctttgtatccgatgtgtctgagattgacttccttgtaagtcattcgttaacaggtttcttgtattttcctagccttctcagccttcattggctggagagcctgtaatgtggctacaggcttctgaggcaagacgatttgctcagtttcaaaatgttaggggtcacatgccatttttcatttgttaattattgaagatgtctttcccacagataagaccccaaggactctcccagactcttcatctcctctctggccctgggcagaactcttccccaggcaaagtctgatttcagtgttcctttctgtcctgcc

SEQ ID NO: 368222 - DNA, 1396 bp, Homo sapiens
cgcggccgcgcctgaggtgatgcggaccccgggcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagttttgatttgaagttcctttaaaggctgttggagcttttgcaaatacccagctaatgaaaggcacttaagattgggcccatctgcatcatcacattgaagttttctgtctaaaggaaggttccagctacctgttacccttttgctaaacacagttgcagtgttgcagtgtatttcatgacaaaagtgcactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccaggtaaggagagatgtgtccaggtggcctttgttgtattgtggggcacagacactgagggagacagggaaaggtctgggagacacaagatggtaccccagaaggccatcctttgtagactagacacacatccaaagggagggctgtttcctggcttattgaggacttttccatttgggctagaagtaaactgagtcagattttgagagatcagtaattccaaagagcagataaggattctatagtaacacagctgggttcactgcacgggttgatgtcaaattgtgcttttcatgttacattagtggattttacaaggcacagattatttgacatttttgtgatgcttgttatagaccaactgtgacatgacagtattattaaaaa

SEQ ID NO: 368223 - DNA, 1931 bp, Homo sapiens
aagaatgctagtgttgtggagaggttctctctgcctcttggctgcagcacacaggcgctgggtggtcagacctgcttccgaggctggctccacagtgactgtgcaaccgcatgtcatcctgtgaaagggcagatacgtgcctcgtcagagccttgtgggagttagtgaggggacttctctaaggcagctagtactcactcaatacttaatgcatcttaaggcacctcttcacagaaggcggtggaaggctgcttacgtgatggcatgtggatagcgatgccatccgtttgtttttttctcctccatgacagagaagcaggaaaacattcctaaatttatttatagacgttaaaaaaaaatcaggcttggttttttcctgtaactgttcttcagccggcagcaagtatagcagcaagtatacagcagcaagtatacagcagcaagtatacagcagcaagtacagcagcagcaagtacagcagcagtactttatgagttgttgtgtttattccctgccttttggctttactcaagaaaaccagttgtgtttctcagagcaactgtattgttttatttgccactctcttcactttgtccattatagtacaatagattgtccttgtcccatctccaaattggaagctccctaggtggtggtcaggctgttgatgagatttgtattctatcaaagctccattttagataatctatcatcattttttatacgcagtaagtcgctgattttgtttctttttttcaaacagttttgatttgaagttcctttaaaggctgttggagcttttgcaaatacccagctaatgaaaggcacttaagattgggcccatctgcatcatcacattgaagttttctgtctaaaggaaggttccagctacctgttacccttttgctaaacacagttgcagtgttgcagtgtatttcatgacaaaagtgcactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccaggtaaggagagatgtgtccaggtggcctttgttgtattgtggggcacagacactgagggagacagggaaaggtctgggagacacaagatggtaccccagaaggccatcctttgtagactagacacacatccaaagggagggctgtttcctggcttattgaggacttttccatttgggctagaagtaaactgagtcagattttgagagatcagtaattccaaagagcagataaggattctatagtaacacagctgggttcactgcacgggttgatgtcaaattgtgcttttcatgttacattagtggattttacaaggcacagattatttgacatttttgtgatgcttgttatagaccaactgtgacatgacagtattattaaaaa

SEQ ID NO: 368224 - DNA, 2149 bp, Homo sapiens
aagaatgctagtgttgtggagaggttctctctgcctcttggctgcagcacacaggcgctgggtggtcagacctgcttccgaggctggctccacagtgactgtgcaaccgcatgtcatcctgtgaaagggcagatacgtgcctcgtcagagccttgtgggagttagtgaggggacttctctaaggcagctagtactcactcaatacttaatgcatcttaaggcacctcttcacagaaggcggtggaaggctgcttacgtgatggcatgtggatagcgatgccatccgtttgtttttttctcctccatgacagagaagcaggaaaacattcctaaatttatttatagacgttaaaaaaaaatcaggcttggttttttcctgtaactgttcttcagccggcagcaagtatagcagcaagtatacagcagcaagtatacagcagcaagtatacagcagcaagtacagcagcagcaagtacagcagcagtactttatgagttgttgtgtttattccctgccttttggctttactcaagaaaaccagttgtgtttctcagagcaactgtattgttttatttgccactctcttcactttgtccattatagtacaatagattgtccttgtcccatctccaaattggaagctccctaggtggtggtcaggctgttgatgagatttgtattctatcaaagctccattttagataatctatcatcattttttatacgcagtaagtcgctgattttgtttctttttttcaaacagttttgatttgaagttcctttaaaggctgttggagcttttgcaaatacccagctaatgaaaggcacttaagattgggcccatctgcatcatcacattgaagttttctgtctaaaggaaggttccagctacctgttacccttttgctaaacacagttgcagtgttgcagtgtatttcatgacaaaagtgcactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccagggggcaggtttgggctggggcctgctgtgtgaccacagtctcccatcttggattgaagctacatcgctgtgtgcatctaactcttgattcacggtctgaccgacgccttggtttctggagaactgccctcgtttatggaagagtcactgtcatcaggagccatcccagggagaggctcagtgggaagtgtaaaggtggagcaagtaaaccggctccagaagagaaggcgaagaaggactatttctgtttagatttgcttaaccgcattttcactttcttgggaacccctgatggagttcaaggtcatagaagagaagaaatcagacactgctacaggactcttgctcttggttcagattattcaatgggaggggagaagagagtagtcgcaagtgattgttgtagattttgtctcagctttttgtttttctttgtatcaaacctgttttgagatcatacactgttacagagaaagagaggaggcatattataaacgtgtggacttcagtgttattccttctcttcaaaatgatgttccaggtgtctagagggtgaggtatgtcatttacatgaaggttaagaataaaacagaaagtgcctct

SEQ ID NO: 368225 - DNA, 2057 bp, Homo sapiens
gggcatctcagtaaatgtgagttttggtgaactgtgtttccaacttgtaagcaagttagactgcaccctgggaagtcagttcacacatgaggagggcctcatctctggcttccctggagcctgagtcaaccaagcttctgatggccaagatcttttcctttgtgtgtggagttgggagaacaatctagtatttttagacctttgtactagacagttttttatggcatttgcttttctttgtcttcgtattcagaaattttgtttgcctaaatttaggctaaccatgaattgactgcatttgaaaggcttattgcacatcaataaggaaaatattgttatcagatgtacttacaatgaggaggaaatgtttccgaacctgccctgaattatatagtctaggtttcgtttactcccatcccctagaattctcccttaaatggacacagagaacctggaagttattgaaagtaaaaggaagaaccagacttgtaaaaatttgttctcagattttgttttcaatgagaccttgggaaagaagtcccttaaaaacaatcagatgctatcttgttctttctttcaagatgccccatggtcttgaaatgatgggccataacaacgtaaaaatctcgctttatgtcttgataggtttccacatgttggcggatgcagtggaagcttctcttgagatctttgccacactgttcaacatgtttgaccactctgtcctaaaaacgctttcttcttaaagcactttctcctcctggcttctgtgtgtcttactctccttgagttccctctgcctctgtggccagtccttcctcacctctcttgctggcaggttaacagtctccacttcaatagcccaaggctcagaaagactgagtaatgcgtctaacctcctctagctgataaagaaccaaggctcagaaagactgaataacgtgtctaacctcctctagctgataaagaagagaacagggatttaaacccagggacggaaactcttctcggttccctataccatattcctgtcttcagggaactgagagcatttagttgcattaaaacaaataaaaaaacaaacaaacaaaaaacctgcaggtatcttgggctctggaaggacatacaggtcagggtgaaaagtatgcttggtccaagcatcttttttcttttaacacatgaagtatgtgtcttattattttaaaagacattgagaaaaaggaacattcaacattctcttggttatagatactggagtattaacaaagtgaaaagagaaaaactaaaatttgttggctctgacttactagttttagtaatttataagaacagctttccatttgtgcctttcatacatccactgagtcatgaggtttcatcaaatgtttctttttttcttttctttctttctttcttttttttttttttttaagacagagtctttgctctgtcgcccaggctggagtgcaggggatgatctctgctcactggaacctctgcctcctggattcaagtgattctcccacctcagtctcccaagtagctggaactgtaggcatgtgccatatgcccggctaatttttgtatttttagtagagacagggtttcaccatgttggccaggctggtctcaaactcctaacctcaagtgatctgcctgcttcggcctcccaaagtgctgggattataggcgtgaaccactgcgcccagcccagatgtttcttagattgactttgctgtgtttcctttgtatccgatgtgtctgagattgacttccttgtaagtcattcgttaacaggtttcttgtattttcctagccttctcagccttcattggctggagagcctgtaatgtggctacaggcttctgaggcaagacgatttgctcagtttcaaaatgttaggggtcacatgccatttttcatttgttaattattgaagatgtctttcccacagataagaccccaaggactctcccagactcttcatctcctctctggccctgggcagaactcttccccaggcaaagtctgatttcagtgttcctttctgtcctgcc

SEQ ID NO: 368226 - DNA, 162 bp, Homo sapiens
tttttttttttgggggtgaggtaaaatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368227 - DNA, 5323 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368228 - DNA, 6761 bp, Homo sapiens
tgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368229 - DNA, 5077 bp, Homo sapiens
gattcaagggcataggcgtcggaattgtgatttcgtgcgtgttttatttaccaggccttcaaatcaaaaaggccaggcaaacacacgttctggggctatcaagaaagttcacacgaaggacaaatccagcagggagaaagtgacataccttgcgggctcaggcttgggatttctgcagccacgcgcgcgttcacccgacgggacctcgcctgcactgccgccgggagaagcctgctctagactccggctccaggggagagggctgggctccacagagaggagcagcctcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368230 - DNA, 1361 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368231 - DNA, 830 bp, Homo sapiens
cctcgtgcgtacttcggcacgagagcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368232 - DNA, 1216 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368233 - DNA, 5397 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtatttttttttttttttttttttttttttttttttttttccacccctccccaaaaacactttttcattcaccagct

SEQ ID NO: 368234 - DNA, 1026 bp, Homo sapiens
cggggcagggaggccggggccgctcccgcggtaaacttgactgtgtcctcttcccccgcagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368235 - DNA, 2654 bp, Homo sapiens
tgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368236 - DNA, 5201 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368237 - DNA, 970 bp, Homo sapiens
gattcaagggcataggcgtcggaattgtgatttcgtgcgtgttttatttaccaggccttcaaatcaaaaaggccaggcaaacacacgttctggggctatcaagaaagttcacacgaaggacaaatccagcagggagaaagtgacataccttgcgggctcaggcttgggatttctgcagccacgcgcgcgttcacccgacgggacctcgcctgcactgccgccgggagaagcctgctctagactccggctccaggggagagggctgggctccacagagaggagcagcctcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368238 - DNA, 1702 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagttttgatttgaagttcctttaaaggctgttggagcttttgcaaatacccagctaatgaaaggcacttaagattgggcccatctgcatcatcacattgaagttttctgtctaaaggaaggttccagctacctgttacccttttgctaaacacagttgcagtgttgcagtgtatttcatgacaaaagtgcactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccaggtaaggagagatgtgtccaggtggcctttgttgtattgtggggcacagacactgagggagacagggaaaggtctgggagacacaagatggtaccccagaaggccatcctttgtagactagacacacatccaaagggagggctgtttcctggcttattgaggacttttccatttgggctagaagtaaactgagtcagattttgagagatcagtaattccaaagagcagataaggattctatagtaacacagctgggttcactgcacgggttgatgtcaaattgtgcttttcatgttacattagtggattttacaaggcacagattatttgacatttttgtgatgcttgttatagaccaactgtgacatgacagtattattaaaaa

SEQ ID NO: 368239 - DNA, 2017 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagttttgatttgaagttcctttaaaggctgttggagcttttgcaaatacccagctaatgaaaggcacttaagattgggcccatctgcatcatcacattgaagttttctgtctaaaggaaggttccagctacctgttacccttttgctaaacacagttgcagtgttgcagtgtatttcatgacaaaagtgcactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccagggggcaggtttgggctggggcctgctgtgtgaccacagtctcccatcttggattgaagctacatcgctgtgtgcatctaactcttgattcacggtctgaccgacgccttggtttctggagaactgccctcgtttatggaagagtcactgtcatcaggagccatcccagggagaggctcagtgggaagtgtaaaggtggagcaagtaaaccggctccagaagagaaggcgaagaaggactatttctgtttagatttgcttaaccgcattttcactttcttgggaacccctgatggagttcaaggtcatagaagagaagaaatcagacactgctacaggactcttgctcttggttcagattattcaatgggaggggagaagagagtagtcgcaagtgattgttgtagattttgtctcagctttttgtttttctttgtatcaaacctgttttgagatcatacactgttacagagaaagagaggaggcatattataaacgtgtggacttcagtgttattccttctcttcaaaatgatgttccaggtgtctagagggtgaggtatgtcatttacatgaaggttaagaataaaacagaaagtgcctctatggtattcttagtggggtttttttcctctgaaaaactgttgccagcatatttgggaatacatccttatattattatttttgagatggggtctctgt

SEQ ID NO: 368240 - DNA, 1612 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagttttgatttgaagttcctttaaaggctgttggagcttttgcaaatacccagctaatgaaaggcacttaagattgggcccatctgcatcatcacattgaagttttctgtctaaaggaaggttccagctacctgttacccttttgctaaacacagttgcagtgttgcagtgtatttcatgacaaaagtgcactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaagggagacagggaaaggtctgggagacacaagatggtaccccagaaggccatcctttgtagactagacacacatccaaagggagggctgtttcctggcttattgaggacttttccatttgggctagaagtaaactgagtcagattttgagagatcagtaattccaaagagcagataaggattctatagtaacacagctgggttcactgcacgggttgatgtcaaattgtgcttttcatgttacattagtggattttacaaggcacagattatttgacatttttgtgatgcttgttatagaccaactgtgacatgacagtattattaaaaa

SEQ ID NO: 368241 - DNA, 708 bp, Homo sapiens
cctcgtgcgtacttcggcacgagagcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368242 - DNA, 1051 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacacgaatgttcaacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacacttgaccaccccttaccccgacacgatgttacaggtagc

SEQ ID NO: 368243 - DNA, 2199 bp, Homo sapiens
tgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggtaaccaggaacactctcggagtttaaccagcaggtccccactgttgttgaagaatggtgatcccattgcagtcccaaactattgaaaccaccatttctattagcaaaaa

SEQ ID NO: 368244 - DNA, 744 bp, Homo sapiens
cgccctccagatagtcgtaggcacagctgtcgtggcgctcaatctcaaaggactggaatgtgaggcccacgtggaaaccctcagacacctggatccgccagatgcagactttgctgggccggtaatcgtctgggtagttgggcgattgaatgtggccatagtcctttttcacatcacccccgcagatggcttcgtagactgcaaagaagccctttccaacccaattgctgctgctgcggaattcaacccagaggcggctccagaagagaaggcgaagaaggactatttctgtttagatttgcttaaccgcattttcactttcttgggaacccctgatggagttcaaggtcatagaagagaagaaatcagacactgctacaggactcttgctcttggttcagattattcaatgggaggggagaagagagtagtcgcaagtgattgttgtagattttgtctcagctttttgtttttctttgtatcaaacctgttttgagatcatacactgttacagagaaagagaggaggcatattataaacgtgtggacttcagtgttattccttctcttcaaaatgatgttccaggtgtctagagggtgaggtatgtcatttacatgaaggttaagaataaaacagaaagtgcctctatggtattcttagtggggtttttttcctctgaaaaactgttgccagcatatttgggaatacatccttatattattatttttgagatggggtctctgt

SEQ ID NO: 368245 - DNA, 503 bp, Homo sapiens
attgcaccaggaccacaacagtgactgtgttttgtgcatgtgtgtctgtgtgtctgtggctgagcagctggccccctatgaggcccgggagcagcaggagctgagggcttgtctgcgctggcgtcgcctccaggacgagatgcaatgctcccccgaggagatgcaggtgttaaggtaaagctgcatggtgatccacagccctctcattcccctccttctttccttcaagacacctccctgccaactgatgacatctgctgtgtttcctttttaaattaagttggggtgggcttcttgtcccccagatgtgatggttatgttctaagtctttcagggcatgcgtttcgatttgccttccgtcattttcctggtgactgtttaggaaaaaactagcatgaggccatttccgggggtcagatccttcgtttgaagttctaacagtcactttacgtggtggctgcggatgtggcgagggttggggtttggcagcctggcagacagta

SEQ ID NO: 368246 - DNA, 595 bp, Homo sapiens
tcagcccacggcctctgtcttctctggggtctttgcaatttctagaccagcaagtgtgtgtggaacaagcacagactgagctcatgtgtgcgtgtgtgtgggtacccacaccttcgcctgatgccctttggcctctgtgccctgcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaaca

SEQ ID NO: 368247 - DNA, 481 bp, Homo sapiens
ctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtaatacgtgtttgcttctaaatttcatactgtttaaaaataataaaggccaggtgcggtggctcatgccta

SEQ ID NO: 368248 - DNA, 1202 bp, Homo sapiens
tgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaaggtactgtacatgtgttctttgcttatttatgtattgcacacatgtggacccaggaacccaataaacagtatttttctaaacttt

SEQ ID NO: 368249 - DNA, 2291 bp, Homo sapiens
tgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcagggtaggtgtcatctttcagcagatggggattctgtaaaggctgtccctgcacttcacacaggaatccacgttctcggtatctctttcataacaaataattaaatctgttacagag

SEQ ID NO: 368250 - DNA, 5570 bp, Homo sapiens
gaaaaaaagaaacagttttccagtgaggcttgtcagggggaagactgatcgccggcaggccggctcggaccatgagcacagttccaagaatgcagggatgaggaggagccgggctgggctgttgagtccaggctgagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368251 - DNA, 4959 bp, Homo sapiens
cccggatgagctcagaccagctactcctagggacacactttgcggggcaggagtcccgtgtctgtaatgccacacaggctctccgcgtggtaattctgggaaccatctctgtctgttcagagcgttcctgacacggccatcatggtgggaatgcctgctcatcgttctgtcaccagtgaaatcgtcagagtctgtgtagagaattgggagctgaggattccttggggttttgagtacaaggaggagacagggattgcagactgcagcttccaaccagcaagtgtgtgtggaacaagcacagactgagctcatgtgtgcgtgtgtgtgggtacccacaccttcgcctgatgccctttggcctctgtgccctgcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368252 - DNA, 5017 bp, Homo sapiens
cgcggccgcgcctgaggtgatgcggaccccgggcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368253 - DNA, 5702 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtaaaaaaaaaaaaaaaaaaaaaaaaaaaaaaaaaaaaaaaaaaaaaaaaaaaaaaaaaaaaaaaaaaaaaagaaaaaaagaaaaaaaaaaaaaaaaggggggggggcccgaaatagaccccccgcggggggccgccaagtagacacgagccccagagtgagcacgaggggggccccaatgggggggcgcatatatcaacagggaagagagggggcggcctgatacaaccgcgctgccgacggagggaaaaacaagacaccggacggcaacagtgctgggacagaggccccccaacttagggggagggaggacatagaggggcgcacccacccccggggaaagaacgcaccccagcggaagaaacaaaccacgccacgaaca

SEQ ID NO: 368254 - DNA, 1091 bp, Homo sapiens
gctttcttcgtgtgaggctgcagcgcaccagctgggccacgccgggaggtgccctcctttgctttcggaggggtgcaggcaatggggcttggatgttgccatttgctggtctcttgtcacaggccctgcctctgcaaggtcagtcatgggacatgtccgtggcattttctgatgtaggaggtgagctggcctgttctgcatcatgctaatggaagaaatggtggcggaacctcagttgcgtgggtggtcttctgggagcacagacttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368255 - DNA, 5385 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcagctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcagaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatccactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaatagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtaatacgtgtttgcttctaaatttcatatttttttttttttttttttttttttttttttttttt

SEQ ID NO: 368256 - DNA, 941 bp, Homo sapiens
gcgcggggagcggccgtgacgaaggtcgcggcccctgcggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368257 - DNA, 910 bp, Homo sapiens
cgcggccgcgcctgaggtgatgcggaccccgggcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggaaagaccacagcaagattctttcattcgtctcctcctagcctgggggaccaggctcgaactgaccctggacatcaaaggagggattatgtggctgctaaagccatcggcccacagccctgttcacgtcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 368258 - DNA, 1318 bp, Homo sapiens
aaaatgcaaagctgattttcatgtttatatatattcataccttgatatattgcaattttagagtttctgcagtctgtctaacttggctgtttgttcataggccagatcaaactaccctcattccccaaaacttggattgtgaagggattagtgccccagaactctctgtgttactggcagggcaaaatgggtaggaatagtctggcttagggaaaaagacatattttctctctaacacaactggcagatactgaagtgggcaggtggcaagaaaaggcaagtactgagctgattcagacttgcagaaagcttcctctcctccttcttagcaaaatgaaaggctctgggaaaaggcacctgcctttccctgccttgaggatcctggcatccttgagtctttattgaagattaatttaatgacttggtcaacaatagcattacctaatcacagagcatcagattatcataagacaaatttaaatgatgccgaagtatcttccagcagaggattagtgatgtaccagcatgcatgtgtagcttgtgtgggtgtgtgtgcatacaagcatgcacatgtgcgcacacacacagagagtctaattggcctttgtcctctgagcagggggcaggtttgggctggggcctgctgtgtgaccacagtctcccatcttggattgaagctacatcgctgtgtgcatctaactcttgattcacggtctgaccgacgccttggtttctggagaactgccctcgtttatggaagagtcactgtcatcaggagccatcccagggagaggctcagtgggaagtgtaaaggtggagcaagtaaaccggctccagaagagaaggcgaagaaggactatttctgtttagatttgcttaaccgcattttcactttcttgggaacccctgatggagttcaaggtcatagaagagaagaaatcagacactgctacaggactcttgctcttggttcagattattcaatgggaggggagaagagagtagtcgcaagtgattgttgtagattttgtctcagctttttgtttttctttgtatcaaacctgttttgagatcatacactgttacagagaaagagaggaggcatattataaacgtgtggacttcagtgttattccttctcttcaaaatgatgttccaggtgtctagagggtgaggtatgtcatttacatgaaggttaagaataaaacagaaagtgcctctatggtattcttagtggggtttttttcctctgaaaaactgttgccagcatatttgggaatacatccttatattattatttttgagatggggtctctgt

SEQ ID NO: 368259 - DNA, 772 bp, Homo sapiens
tgctgcggtcatctagaggatcccgacgagttgtccgagttatgaatatggaatgaagggataaattcctgatgtctccattaagctcctctgtgtaaaatactccatggcaaagttgctgctatttaaagtagtgagtttgatcttggctttgatctaaatcttttgatcttgaaagaaggatggagtagcaataaagagagggcaagacagattttctttaaagaaatgtgataaagttaaagggatggtcaagacccagcaagtaactcggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcagtagaaggtccagaatgccggtccgagcgtgacta

SEQ ID NO: 368260 - DNA, 2178 bp, Homo sapiens
tgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagactttaaattggagtcatctaagaaatagagagagaagaagaaagaagtggattacttttaaaacactaggaggaattttatttactgtaaagcagatgagaaatttgtttgcccaagtttagaatttcagtatgttactttgcagaagtttggactgcctgtcttttgattttgtattaaaacttgatttgtcattgtaatatca

SEQ ID NO: 368261 - DNA, 1772 bp, Homo sapiens
gttgattaatatttattaaacttccatatgccagttgccaaggatgtaaaaatatgacagggtgtctggcctcaaaggagcatagtctagtgggaagacttgacatgtaaacatataataatattaaaagcattgcatagtaattggggaacacaaaggaggagaaactgtttcaagaaaggatagaaataaatggtcaaggcagacatgaagtagtgttctgattagttttaagagaaatgtaggtgttttacatgttggtggatggggaaagtgcagaggtatgtgtgtgaaatgtgcatggtgtctctggagagctttaactagttccatgtgacctgaggtataggttaggctgtgagactgaaaaaggggagagaagggatactgtaaaggctttatatattatgctgagttatctaaggtgcgaaatgatcagacttacattctagccaaaatgagtcagatgagtgttgatgatgctttggtggaaaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368262 - DNA, 1120 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgctgtgacacctcccatatcccccccctcaaccggaaggctgactgcccggagaatgccaccatgtctctgaagcatctcaccaagaagctgctaaaccgggatatccagagagcgagactctgtctcaaaaaaaaaaaaaaattaaaattgtgtggtccctttccatgtcacagagtctgcttttggctcagagtctgtatctagcctgtgtcaggatattgcctgttcttcccaccttttcatccataagccacttctttcccaattacctcttccgcccttccaatggccccttatgtctactttacggcgtcaactctgattggggggaccctcctcccaagaaaggctttaggaaggaattgccaagcaccgaaatttgtgtcaagaagcggaggctcttaagactcagagggtcgagctctataagccctcaattcccttcattttacccattggagactccaccctaagagcgcggaaatggccctttactaaggacccaagtgcttggtggactggcgctcactaagaatccaggtggcgtggttaacaccaattggtcctcccctcaatttcgtgtgtgtgttctccattccccctttggcttggagattggcctgttgtttccctccataagtctaccggggaccggcttacccttttctcccggcgggggccatacacgacacttttccccggtgtcgacccctgtggcgggtcgcgaaggccccccctttccacgcccggggggtcctcgcgcggccgagaagggtggcccccgtgaggtcccacag

SEQ ID NO: 368263 - DNA, 5035 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368264 - DNA, 5074 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368265 - DNA, 4751 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgctggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368266 - DNA, 5451 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgcttatccaggtgggctgcctcaagcctcgatcccacccccgcgctggtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttatctacgccatacttctcactgtttttgagcatacctagatgttcctttcctaggcggagtatagatcgcacgtgttctagcctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368267 - DNA, 5307 bp, Homo sapiens
  misc_feature (1)..(1): n is a, c, g, or t
ncgttagaggtgaggtgactgactattttagaaaagacggaaagaagagttaaacatcttgtgcacaaaggggcgcagccaagcaaaggcataggagaggcagaagatgggacgggtctgagacagcaaatctgcccagctttgatgagggctatatgtcgaggttaataagaagtgaaggtggtggtggacagtaagtaggtgaagtcaggagtaacgaaatatctagttcacgggactacgtctggttttcatcataaagcacttccccagtgccaagctggggttatgagactaaggtatgtccagatgagcctagccccttcagagggggtccctttgggaggctatgcaggactgtcacttttgttgaaaacctgtttggaacctcatttgggaatggccttcagagcctgtggtgtgttcttcggttgtcctcattggtagcatgtcctcctacttcaagagcctgaaatggctaggtgtggtgacatgtgtctgtaatcccagctactcaggagtttgaggtgagagcattgcttgagcccaggagtttgaggccagccaacctgggaaaaatagcaagacctcatctcttttaaaaaataagttacctgaaggccaggtgtggtggctcacacctgtaatcccagcactttgggagcctgaagcgggcagatcacaagatcaggagttcaagaccagcctggcccatatggtgaaactccgtctctactaaaaatacaaaacttagccaggcatggtggcaggtgccagtagtcccagctacttgggaggctgaggcaggagaaacgcttgaacccgggaggcggaggttgtagtgagccaagatcgcgccagtacactccagcctgggcaacagagcaagactccatctcaaaaaaaaaaaacagtttcctgaaatattgagaagttatttttattttacttggttccaaaactagtgtgaataaggttgcttctgcaactttagtttatatgtgattcttaattttttacggtttgtagactctgagaatttgatgaaagccacagattctcttcctctagtacccatacacatctaattgcatgtaattttgggcttttgttagcctccctggagcccgggtcccagccatgtgtctaaggccaacataatggtaatagttaaaggacttcatgtagcaagccagaactgaactaaatacatggacatctcaaacatgagtgtcatttaggactgaaggcaaattaatgtcatggggtggagatcaataagaaggtaaggagccactggcagtatgagtccaaacagggtataccatggaaatcacctgtggaagaggaaggtggattccagaagaaagaaaacttgtgggagtgagcatttcaaggatggagagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368268 - DNA, 4461 bp, Homo sapiens
ctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatgaaaggggaaagccttcacgtcagaacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368269 - DNA, 2333 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgcttatccaggtgggctgcctcaagcctcgatcccacccccgcgctggtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttatctacgccatacttctcactgtttttgagcatacctagatgttcctttcctaggcggagtatagatcgcacgtgttctagcctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccagtgggaagagctgcgaagcgagctgatggctgcagaacaggaggatgacgtggagggtgtgtgcaagcctctgtctgcggctggagaacacaaaacactccgtgtgcgtgggccctgtcttcaccccagcgagcatcatgtgagtgggcctcgttccccccggagaatcacagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttcc

SEQ ID NO: 368270 - DNA, 378 bp, Homo sapiens
gaaattacataaggagtaggaccccaccagaattctgtctttgtaggctgctgactgcagaagaaactgtgtagcggaggcagggggaagaggagtacagagagtacactgggaaggaagaaacggtttcttttctcttcatgctcttgtcttccttgcttgctcaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatcttt

SEQ ID NO: 368271 - DNA, 5680 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgcttatccaggtgggctgcctcaagcctcgatcccacccccgcgctggtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttatctacgccatacttctcactgtttttgagcatacctagatgttcctttcctaggcggagtatagatcgcacgtgttctagcctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368272 - DNA, 5342 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgcttatccaggtgggctgcctcaagcctcgatcccacccccgcgctggtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttatctacgccatacttctcactgtttttgagcatacctagatgttcctttcctaggcggagtatagatcgcacgtgttctagcctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368273 - DNA, 5089 bp, Homo sapiens
cgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcacaccgatttccgcatccggctccggacgcttccggtcttagctggacccgtctgggaggtaggtttgtgagcgtgagagatcgatctgtaccgcggggatccgaagtatgctggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaaataagtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggggcagagcaggggagaaagggtgcttggtgatgacagcctggtcctgctgccagcttttggtggtacacaccccatcttgggaaagagtcaccagtctgaccttgtgtccaggatcattatctgcactttcttgagagaatgcagactccatgtctacacaaggacttttgcattcttgagtggctggtctggttccaggggccagagtcacggtcacagctgcctatagaagtgaatttcgtgcagccagaccagacccagacatggtcttgttgaggcctgcactgtggggtctgttgcacaggcagccattgtgctctgagcaaattggttcctgtggggcccaacatatttaatgtccatgacttcacaaaggggtgccaggtatccttgcacagcaagaactaagaatagtgcaaggaggccgcaacagaaactggtaagaatacacacatgcaagcgattcttaactacattgtaatcagtaaatgaagataacgacaatattctcattagggtacttactggctgaaacaaaactaactttgtcaggccggtgcagtggctcacacccgtaatcccagcactttggggaggctgaggcaggaggatggcttgagcccaggagtttgagaccagcctgggcaacatagtgaaaccccatcgctaccaaaaaaaaaaaaaaaaaaaaccctggctttgtatgtgtcttggtaaagtagcaactggcttttatgatccccctacccccacaccctgtgtctaaaagggcacatgactgctacagcctcaaaacaaaagtacttgatctcagtccaatgttgaaaagagctcattctgcctggcacggtggctcacgcctgtaatgccagcactttgggaggccgaggtgggtggatcatgaggtcaggagattgagaccatcctggctaacacggtgaaaccccatctctactaaaaaaatacaaaaaattagccaggcgtcgtggtgggcgcctgtattcccagctactcgggaggctgaggcaggagaatggcgtgaacccgcgaggcggagcttgcagtgagccgagatcgcaccgctgcactccagcctgggcgacagagcgagactccgtctcaaaaaaaaaaaaaaaagagaaaagagctcattcttacttttgctcaccaagaaaaacctgggagacgagaagaccttgcaggcaattccttaactgtttaccctcatcacacttccttgtcagagcccagcttacctagcaagggtgcctgggaatcccctgtacttcaatccccttcctgttctgtctctgtcctgacttcatccagttgatagtggacaaaccctattgtagattgctgcctgaaccccagtcagcaagtcctgttttggcttaaatctaaggtcttgttggatgtgatggctcacgcccgtaatcccaacacagagactaagacagatcacttgaggtcaggagttcgagaccagcctgggcaacatgaaaccccatctctactaaaaatacaaaaatacaaaaaaatccccagcacatggggcacatgcctatattcccagctacttgggatgctgaggcaggaggatagcttgaacccgggaggcagaggttgcagtcagccaagattgtgccactgaactccactccagcctgggcgacagagtgaggactccgtctcaaaaa

SEQ ID NO: 368274 - DNA, 2367 bp, Homo sapiens
cttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368275 - DNA, 676 bp, Homo sapiens
gagtaattgagtgatagagtacttttttccagcagacacagttctttagaatacaagtcgcctcaagagtcttcttaatgagatttagccagttagcctgtgttccagacaaggttagttgcagaaaagaggagacgcctgctttcattctgtgacaaacttaccagtagtgttgcgctttcattctgtgacaaacttaccagtagtgtcgcttatcctggcctctcttactcctctttcatggtgcattgatctctacctcaagcctcctttattgcatgggaaggattttcatgagatttctgccttaattctacattttccttctttagttagccactgaacaaaggatggaatttatcctatgtactcaaaatctcacaaaaaggagctagcatagctgtgtctttttgactgatatcgctcccctggcatatgccatcatcatttctttttttttttttttttcaaaccctttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368276 - DNA, 833 bp, Homo sapiens
cttcttcgcgattgcacggattcagggacgctcagtggcgccgcgccgctccttggtttgacttttgtttttcagttgcgttccctgactcggagtcttagtgtgtcgtaaggtctcactctgtcacctaggctggagagcagtggggcaatctcagctcagtgcagcctctgcctcccaagctcaagcaatcctctgcctcagcctcctgaatagctgggactacaggcacgtgccaccactcccagctaattcctgtctttactaaaaatacaaaaaaaattagccacagtggcaggtgcctgtaatcccagccactggggaggctgaggcaggagaatcacttgaacccaggaggtggaggttgcagtgagccaagatcgtgccactgcactccagcctgggctgaacagagtgagactctgtctcaaaaaataaataaataaataggtagttggcactatctaattaagaatacaagtgaaggagtaactattggatggaggaggatagaaacagaaaagagcaattgaatttattaatttggatgtctgctgaccaataagagcttggttagatgtcatagtagaagcccgaggcctggctcagtggctcatgcctgtaatctcagcactttggaaggccaagggaggaggattgtttgagtccgggagttcaaggccagcctgggcaacatagcaaggccccgtcttgcagccagagaggtgagtgtagacaacttttcgtagacatgtgcaacagtgaggacagtcactatgaaggagaagagggattgcaggttgttagaagggtctttcaaagcttcaaattac

SEQ ID NO: 368277 - DNA, 2433 bp, Homo sapiens
cttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaacgggtcatagaactaaagggagccttgaaaagactgtcttcctcagaaacccccgcctctacgtagtcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368278 - DNA, 2313 bp, Homo sapiens
cttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368279 - DNA, 2220 bp, Homo sapiens
tgtggctgtttgtctccttgcccgccaaagttctgcccagtccaacgactccacgcagctcgcccttggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368280 - DNA, 2088 bp, Homo sapiens
cttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368281 - DNA, 2072 bp, Homo sapiens
cttcttcgcgattgcacggattcagggacgctcagtggcgccgcgccgctccttggtttgacttttgtttttcagttgcgttccctgactcggagtcttagtgtgtcgcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaacgggtcatagaactaaagggagccttgaaaagactgtcttcctcagaaacccccgcctctacgtagtcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368282 - DNA, 1345 bp, Homo sapiens
gagtaattgagtgatagagtacttttttccagcagacacagttctttagaatacaagtcgcctcaagagtcttcttaatgagatttagccagttagcctgtgttccagacaaggttagttgcagaaaagaggagacgcctgctttcattctgtgacaaacttaccagtagtgttgcgctttcattctgtgacaaacttaccagtagtgtcgcttatcctggcctctcttactcctctttcatggtgcattgatctctacctcaagcctcctttattgcatgggaaggattttcatgagatttctgccttaattctacattttccttctttagttagccactgaacaaaggatggaatttatcctatgtactcaaaatctcacaaaaaggagctagcatagctgtgtctttttgactgatatcgctcccctggcatatgccatcatcatttctttttttttttttttttcaaacccgcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368283 - DNA, 1577 bp, Homo sapiens
cttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaaggtaatgtccttatgtcgtaacgaagttgtttatttttctgggagagttgaaggaattccaaagaacctacaatttgtaatgtaagatccattcagtccaggaagctctggtagcagctgcctcaagaactaggtttcaaagagcagctgatcgttgtagtatttggggattcaaaatattagacttgttgattcattcattcattcattcaacaaatatttattgtactcctggccgggcacagtggttcacgcctgtaatcccagcactttgggaggcctaggtgggcaaatcgtgaggtcaggagttcaagaccagcctggccaacatggtgaaaccccgtctctactaaaaataca

SEQ ID NO: 368284 - DNA, 378 bp, Homo sapiens
accagagaaatcagaacaaaatcaaagagctaaccaaaaagtgagtgtctaagaaagctgtacctaacgggtattgtatttttctgagtgacttaaaagttaacattttgtacttgaacaacagcgggtcatagaactaaagggagccttgaaaagactgtcttcctcagaaacccccgcctctacgtaggtgagtacctcgcttttccaggcgtgctgttgaagagctgatgagtatttcacgtgctccttttaatccattttggtgttttagcttgcttctggtggctaagaagtgttcttaggccgggtgcagtggctcacgcctgtaatcgctcctgcctgggtgacagagtgagaccctgtctcaaaaaaaaa

SEQ ID NO: 368285 - DNA, 302 bp, Homo sapiens
tgcactccagcctgggggacagagcaagaccttgtcttgaaatgaacaagaggattaggattgagatgtttttgtttgtgtttgttttttaatttttctggagaaaggctcacttttcctagaggtatgaagtaagtggaagtagggctggattcctcacccctttttggcctgtctaggtggaagcactgcaggctcagctgggagagcagaccaaactttctcgagaacaaattgaagggctcatcgaggacagacggattcaccttgaggaaatacaagttcagcaccagagaaatcag

SEQ ID NO: 368286 - DNA, 2259 bp, Homo sapiens
cttcttcgcgattgcacggattcagggacgctcagtggcgccgcgccgctccttggtttgacttttgtttttcagttgcgttccctgactcggagtcttagtgtgtcgcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368287 - DNA, 2313 bp, Homo sapiens
cttcttcgcgattgcacggattcagggacgctcagtggcgccgcgccgctccttggtttgacttttgtttttcagttgcgttccctgactcggagtcttagtgtgtcgtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368288 - DNA, 1590 bp, Homo sapiens
gtatttgaagggttgtgtgaaataagtaacatgatctgatttgggtttttaaaagatcattttaactgctcaatagggcatgtataataagcgttgttgttaatatttcttcctttttaaagaagaactttagaaatgtagcccaaaacatatattgtaatgtcttccttgggacagcttctgagctccgttatctgagtcttcccagagccaaaaatatttgttttaatttttactgtgtacactttagaaaaagggcttaagagactggtctagaagtagattttcagatgttcctcaaagttccttgtcatctggttccttaactcattttgtacctctggaaatcccttcttttctttctttctttgcctaaaagctacttgaattacctgaattgtagaactgagtgttaatgttttttgtccctttgacttgtagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaag

SEQ ID NO: 368289 - DNA, 2813 bp, Homo sapiens
cttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaagcaaaagaaaaaaaaaaaaaaaaaaaaaaaggaacaaagagagagaaagaaagaaaaaaagagggggggcgggaaacatgggagaaaagatacgaggacaggggggggccaaagagggggggtaacaccagatgaagacatgtgataacactggaggagaccccaaaaatgagaggggcagaaagaagaatagacaaagaaacaaacgggaccacaataaaacaacaacaaaagccgaaggaagcaacggagcggagaaacaaccaatgagagaacccagacggaaagcacatactagaaacaagagggagcaacatgaagaacaatagaagggagggagaacacacgaaatagggacgaacaccacgcaaaaggagaccaagaaaagagttcaaaaggagccacaaggggaacaaccatataaaacaacgggcaaacaagaagaca

SEQ ID NO: 368290 - DNA, 400 bp, Homo sapiens
ttgagggattattgggaaaattattgggaccactattggaacagttgacaaactgtcactgggggtgtgtagattaaatgtcagtatcgtataaatccatgttaatttcctggtagtgatgacagcactgtgattatataggagtgtgtccttggtgtttgggaattacatggtgaaatgtttaggataatggggcaacttactttcaaacggttccccaaaaattctagatagatagatagatagatagacagacaggcaggcagagtgagaaagaaagtgagaatggtaaaacaaatatatataatgttttgtggggagaatgaataggagttttttgtagtattcttacgacttttccataagtttgaaattatcaaaaataaaaaatgtttaaaac

SEQ ID NO: 368291 - DNA, 947 bp, Homo sapiens
atgaatgcagctttcttggtgtcttgatgtttgtgaatttctgtggagtttgatactgctccttttgctgcttgtttttccagagtccccttatcacttgacgtgctgttatattatgtttgatttattacagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368292 - DNA, 495 bp, Homo sapiens
gccctcccatttccggaagcctggcgcaaggttggtctgcaggtggcctccaggtgcaaagtgggaagtgtgagtcctccacatcccaggatgctgggggactgagtcctggtttctggcagactggtctctctctctctctttttctatctctaatctttccttgttcaggtttcttggagaatctctgggaaagaaaaaagaaaaactgttataaactctgtgtgaatggtgaatgaatgggggaggacaagggcttgcgcttgtcctccagtttgtagctccacggcgaaagctacggagttcaagtgggccctcacctgcggttccgtggcgacctcataaggcttaaggcagcatccggcatagctcgatccgagccgggggtttataccggcctgtcaatgctaagaggagcccaagtcccctaagggggagcggccaggcgggcatctgactgatcccatcacgggaccccctccccttgtttgtcta

SEQ ID NO: 368293 - DNA, 808 bp, Homo sapiens
gcacggcgggtatagtggttccgcaaccttgggatgttcggctgagcgcctgcctaacatgggagcgcctgcctaaccctcctgactggagggtcagcggcggggagtcctggccttcaatcggccatcgccacggcagaaactggggcccgggctgcgtccaggcccttccccgtccgtccacaggtctcatgggcgcccggactggggctgatgtagtttcccgacctctgacacataggatctggagattaaagctgctctgctaataattaggttcccacctctcaagatcattaggagcttcttttccaattcctctgttttgcatgcattggaaggaaaatggtgacgccgagggtgactgatttccaggtttacatcggttgccccaggggaagtgcctggcccccatctggtccttgctgctctaactttgccctgttaattgaagaaatgcagaatctggagctcaggaaccaccactctccccaacccattgcaggcttgaacatttgatggtggaaaccctgccctgagtttgtattatggtccagattttgaacaaatctcgctagagattgaacaggtaaggctcacctttcgatagttacaccaagaaacgcctagctgatgacttaagctatggttttgggcagcatgagagtggtcaggtggacagtagggaagtctatacaacccaaagggaaaagagaaaaggcccatgagaaatcagggcaaattgccacagtgtgtttttcttgatggtgtcactgaaatgtgggttaccttcccactgtgtccccca

SEQ ID NO: 368294 - DNA, 283 bp, Homo sapiens
tttcactctgtttataatttaggtggattttcacatctcaagccagctaagagtatgggaaataggactcgttaaagcacagatatcacacaagtgattcagattcacgagggtaatccagatgaaggtatatcattgtacctggcccgcatcactcagtaactgtcacctttgatttattgatttacttgagatggagtttggttctgggcaacaagagcaaaactccgtctcaaaatagataaataaaataaataataatctgtacatttatatttatgta

SEQ ID NO: 368295 - DNA, 1670 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctgataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368296 - DNA, 1794 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaaacggagtcttgctctgttgtccaggctggagtgtagtgtggcgatctcggctccctgcaagaatctgcctcccggattcacgccattttcccacctcagcccctggagtagctggaagtgcaggctcccgccaccacgcctggctaattttgttttgtatttttggtagagacggggtttcactgtgttaggtaggatggtctcgatctcctgacctcatgatccatccgccttggcctctcaaagtgctgggattacaggcatgagccaccgcacctggctgttttttcatttctattatgatttgttctgtggaatgtcagtgacttagcggtgtttttcacatgtttataaagctgaatagttctgtatgtcagctcagcacccctagtgtcagtcatgctactctcctgctgtgcatagatgggggcctgtccacacccaaatctcctgggttcccgctgtccgcacctgaaggtacccaccagatgtgtctgtcactgccctccatccacctttcttgtggttctcatgtttctgcctccctagagaccatttctctctacagcagtagtttccaatagaaatacaatgccagacacatacgtcattttagattttctagtagtcactttagaaaagtgaaaaagaggccagctgcagtggctcacacctgtaatcccagcactttggaaggctgaggtgggtggatcacgaggtcaggagatcgagaccatcctggccaacatggtgaaaccccctctctactaaaaatacaaaaaattagctgggcgtggtggcaggcgcctgtggtcccagctactcgagaggctgaggcaggagaatggcgtgaacccggtgggcagagcttgcagtgagccgagatagcgccactgcactccagcctgggcgacagagggagactccatctcaaaaaaaaaaaaaaggttacaaagaaacaggtgaaattagttttatttcacctaaaatgttagcattatccaaaatatcacttcaacatcttatcaaaataaaaattattaatgagaaaa

SEQ ID NO: 368297 - DNA, 1117 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctggtggattttcacatctcaagccagctaagagtatgggaaataggactcgttaaagcacagatatcacacaagtgattcagattcacgagggtaatccagatgaaggtatatcattgtacctggcccgcatcactcagtaactgtcacctttgatttattgatttacttgagatggagtttggttctgggcaacaagagcaaaactccgtctcaaaatagataaataaaataaataataatctgtacatttatatttatgta

SEQ ID NO: 368298 - DNA, 1025 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctgctacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtg

SEQ ID NO: 368299 - DNA, 1953 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagagtctcactctgtttcccaggctggagttctgtggcaccgtgttggctcactgcaacctccgtctcctgggttcaagcaattctcttgcctcagcctccagagtagctgggattacaggtgcccaccaccacacccggctaatttttttatatttttagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaaacggagtcttgctctgttgtccaggctggagtgtagtgtggcgatctcggctccctgcaagaatctgcctcccggattcacgccattttcccacctcagcccctggagtagctggaagtgcaggctcccgccaccacgcctggctaattttgttttgtatttttggtagagacggggtttcactgtgttaggtaggatggtctcgatctcctgacctcatgatccatccgccttggcctctcaaagtgctgggattacaggcatgagccaccgcacctggctgttttttcatttctattatgatttgttctgtggaatgtcagtgacttagcggtgtttttcacatgtttataaagctgaatagttctgtatgtcagctcagcacccctagtgtcagtcatgctactctcctgctgtgcatagatgggggcctgtccacacccaaatctcctgggttcccgctgtccgcacctgaaggtacccaccagatgtgtctgtcactgccctccatccacctttcttgtggttctcatgtttctgcctccctagagaccatttctctctacagcagtagtttccaatagaaatacaatgccagacacatacgtcattttagattttctagtagtcactttagaaaagtgaaaaagaggccagctgcagtggctcacacctgtaatcccagcactttggaaggctgaggtgggtggatcacgaggtcaggagatcgagaccatcctggccaacatggtgaaaccccctctctactaaaaatacaaaaaattagctgggcgtggtggcaggcgcctgtggtcccagctactcgagaggctgaggcaggagaatggcgtgaacccggtgggcagagcttgcagtgagccgagatagcgccactgcactccagcctgggcgacagagggagactccatctcaaaaaaaaaaaaaaggttacaaagaaacaggtgaaattagttttatttcacctaaaatgttagcattatccaaaatatcacttcaacatcttatcaaaataaaaattattaatgagaaaa

SEQ ID NO: 368300 - DNA, 790 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggaaaggtggatgccaccgtgttcacagacagtagcagcttcctcgagaagggactacgaaaggccggtgcagctgttaccatggagacagatgtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagcca

SEQ ID NO: 368301 - DNA, 2087 bp, Homo sapiens
ggaccacctgaggtgaggggttcaaaaccagcctggccaacatggcaaaaccccatctctgctaaaaatacaaaattagctgggcatggtggcgcatgcctgtaatcccagctacttgggaggctgagggaggagaattgtttgaacctgggaggtggaggttgcagtgagccaaaatcacgccattgcactccagcctgggcaacaagagcaagactccatctcaaaaacaaacaaacaaacaaagggtggaaaagagggattccagagtgccaggcacacagattttctggaaggtttacatgaggactgctgtggtttgaatgtgttccccaaagttcatgtgttggaaactcaacccctaatgcaacagtgttgaccagtggaacctttaagaggtgattaggtcatgaaggctctgccctcatgaatggatgaagctagagtgggttagttatcttgggagggggttcctgataaaaggatgaggttggcttccttccctttctctttccccctcccccctctcacatgtggtcactctcttgcccttccaccttccaccataggacggcacagcgagaccttcaccagatgcaggcccctcactttcccagtgttcagaaccgtaaaccaagtgaactctgcttataaatcacccagtctgtggtattctgttatagcaacacaaacggactaagagagggacactcagtgggctcttctacttgatggagcactccctgcgtggtgccttgtatttgtagacatgatgctgtaaatgctctttgaatgtcttgaaggcttttatgtttgaggagtttacagagaagcacctacaggcttcaggtcccttcttctgttgcttctttgctccttagttcctcccctaacctggtgctaaattagatcatagtgtggtccttggaccaacagtatcaatagcacctgaaaatcatgctggaaatacagattcacaggctgctccctagaatactgaagaagaaactctaggagtgagacccaacaatctgtatttaacaagtccccaggtgagtctgatgcacacagaaatgtgagctgctgtattagatggtgttgagttcatgccaccgaatcactgacacacacgtctgctcactgcttgctctttgcacaggcccctggatcctcctggaatccccgatccctcttgctccctggcagagttttctagtccctcttacttgaagcatgtctttcagagcccggcaccacccatcttgagtatctgataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368302 - DNA, 1390 bp, Homo sapiens
gccctcccatttccggaagcctggcgcaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctgataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368303 - DNA, 794 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggtccagattttgaacaaatctcgctagagattgaacagagctgcgcctggatcccgccacagtgaggagacctgaagaccagagaaaacacagcaacctgggcgacagagggagactccatctcaaaaaaaaaaaaaaggttacaaagaaacaggtgaaattagttttatttcacctaaaatgttagcattatccaaaatatcacttcaacatcttatcaaaataaaaattattaatgagaaaa

SEQ ID NO: 368304 - DNA, 1870 bp, Homo sapiens
ggaccacctgaggtgaggggttcaaaaccagcctggccaacatggcaaaaccccatctctgctaaaaatacaaaattagctgggcatggtggcgcatgcctgtaatcccagctacttgggaggctgagggaggagaattgtttgaacctgggaggtggaggttgcagtgagccaaaatcacgccattgcactccagcctgggcaacaagagcaagactccatctcaaaaacaaacaaacaaacaaagggtggaaaagagggattccagagtgccaggcacacagattttctggaaggtttacatgaggactgctgtggtttgaatgtgttccccaaagttcatgtgttggaaactcaacccctaatgcaacagtgttgaccagtggaacctttaagaggtgattaggtcatgaaggctctgccctcatgaatggatgaagctagagtgggttagttatcttgggagggggttcctgataaaaggatgaggttggcttccttccctttctctttccccctcccccctctcacatgtggtcactctcttgcccttccaccttccaccataggacggcacagcgagaccttcaccagatgcaggcccctcactttcccagtgttcagaaccgtaaaccaagtgaactctgcttataaatcacccagtctgtggtattctgttatagcaacacaaacggactaagagagggacactcagtgggctcttctacttgatggagcactccctgcgtggtgccttgtatttgtagacatgatgctgtaaatgctctttgaatgtcttgaaggcttttatgtttgaggagtttacagagaagcacctacaggcttcaggtcccttcttctgttgcttctttgctccttagttcctcccctaacctggtgctaaattagatcatagtgtggtccttggaccaacagtatcaatagcacctgaaaatcatgctggaaatacagattcacaggctgctccctagaatactgaagaagaaactctaggagtgagacccaacaatctgtatttaacaagtccccaggtgagtctgatgcacacagaaatgtgagctgctgtattagatggtgttgagttcatgccaccgaatcactgacacacacgtctgctcactgcttgctctttgcacaggcccctggatcctcctggaatccccgatccctcttgctccctggcagagttttctagtccctcttacttgaagcatgtctttcagagcccggcaccacccatcttgagtatctggtgagttctgtggtctgcatgtccatgtttgggacattctgggaagggtggcccaggctgtgatttgccatctactgcaggctatggatggtattcagaagggaggggagatgctgtgtgcgtgttctgaagggtttcccactaaacagatcaaccctctccataactatttgatttttactttatctcctcgttgacttcacagtgtcagtgcagtttgtgtaaacatctctatggggtgatgcatgcagataaatgtttatgtgaacatataaagtctgcatgtgtgggtgaacactccacatcaggtcattgtccatcattacatatctgtggtgtctggctcattcgtctcgttttctgtcattttacctacttttacctgaagtacaatgactatttaataactattaaatgtttcatttcaactacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtg

SEQ ID NO: 368305 - DNA, 1215 bp, Homo sapiens
gcacggcgggtatagtggttccgcaaccttgggatgttcggctgagcgcctgcctaacatgggagcgcctgcctaaccctcctgactggagggtcagcggcggggagtcctggccttcaatcggccatcgccacggcagaaactggggcccgggctgcgtccaggcccttccccgtccgtccacaggtctcatgggcgcccggactggggctgatgtagtttcccgacctctgacacataggatctggagattaaagctgctctgctaataattaggttcccacctctcaagatcattaggagcttcttttccaattcctctgttttgcatgcattggaaggtggattttcacatctcaagccagctaagagtatgggaaataggactcgttaaagcacagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368306 - DNA, 1155 bp, Homo sapiens
gcacggcgggtatagtggttccgcaaccttgggatgttcggctgagcgcctgcctaacatgggagcgcctgcctaaccctcctgactggagggtcagcggcggggagtcctggccttcaatcggccatcgccacggcagaaactggggcccgggctgcgtccaggcccttccccgtccgtccacaggtctcatgggcgcccggactggggctgatgtagtttcccgacctctgacacataggatctggagattaaagctgctctgctaataattaggttcccacctctcaagatcattaggagcttcttttccaattcctctgttttgcatgcattggaagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368307 - DNA, 759 bp, Homo sapiens
gccctcccatttccggaagcctggcgcaaggttggtctgcaggtggcctccaggtgcaaagtgggaagtgtgagtccgtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaaacggagtcttgctctgttgtccaggctggagtgtagtgtggcgatctcggctccctgcaagaatctgcctcccggattcacgccattttcccacctcagcccctggagtagctggaagtgcaggctcccgccaccacgcctggctaattttgttttgtatttttggtagagacggggtttcactgtagtcccagcactttgagagtccaaggcgggcgcatcacctgaggtcaggggttcgagaccatcc

SEQ ID NO: 368308 - DNA, 563 bp, Homo sapiens
tcatatgtaatttacagagcaaatacctaccagaatggataacttgagagatgtggaaagtgagtttctttgcgcttatctagtgagggtgatttttagtcaataagcatttggtatatgcctgggaatccaacagctgctatttagattcagagccagcctttatttatcagctttctgatgctgaacccatcagtgaacttctctgtatatttgattcatcataaggaaaatggtgacgccgagggtgactgatttccaggtttacatcggttgccccaggggaagtgcctggcccccatctggtccttgctgctctaactttgccctgttaattgaagaaatgcaggtataaacacttcctgggttgttgctggcatttattgtcctcacagtttacagagaagcccatattttcagcctcttcctctgctttctgtcatttctgaaccatctcacccgacctggtgtaattttcattgtgtgtgagtttgcacagatgtaatttgggcctacatgtgtccaaagcctaatgcccacctcccacctccactaggatctgg

SEQ ID NO: 368309 - DNA, 745 bp, Homo sapiens
tcactcccgcatcaaaaaggccaacggagcccaactagaaacatgggtccccaggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattct

SEQ ID NO: 368310 - DNA, 702 bp, Homo sapiens
gacagagtcttgctctgttgcccaggctggagtgcagtggcgcgatctcggctccctgcaagaatctgcctcccagattcacgccattttcccacctcagcccctggagtagctggaagtacaggctcccgccaccacgcccggctaatttttttatatttttagtagacacggggtttcaccatgttggccaggccggtcttgaactcgtgacgtcaggtgatgcacccgccttggcctcccaaagtgctgggattacaggtgggtgcctggccaaggggctgatatttcttaagggctttccccaagaaggaaaaagccaaacctactcaggcaaatcttgtttatttattcttctaggtccagattttgaacaaatctcgctagagattgaacagagctgcgcctggatcccgccacagtgaggagacctgaagaccagagaaaacacagcaaagtaggccctttaaactactcacctgtgttgtcttctaatttattctgttttattttgtttccatcattttaaggggttaaaatcatcttgttcagacctcagcatataaaatgacccatctgtagacctcaggctccaaccataccccaagagttgtctggttttgtttaaattactgccaggtttcagctgcagatatccctggaaggaatattccagattccctgagtagtttccaggttaaa

SEQ ID NO: 368311 - DNA, 1035 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccaggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgattgttcccaaaccagtgggatgtttgcacgggttactaaccggttaacttccttcttataacacatgtcacctgatggtcctaataaagcgaagacaccggttaagggagccagaaatggggccacaccagatggaaggggttcgccggcgcacggctttatccgggtctctttttgccc

SEQ ID NO: 368312 - DNA, 1110 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaaacggagtcttgctctgttgtccaggctggagtgtagtgtggcgatctcggctccctgcaagaatctgcctccccccctctctactaaaaatacaaaaaattagctgggcgtggtggcaggcgcctgtggtcccagctactcgagaggctgaggcaggagaatggcgtgaacccggtgggcagagcttgcagtgagccgagatagcgccactgcactccagcctgggcgacagagggagactccatctcaaaaaaaaaaaaaaggttacaaagaaacaggtgaaattagttttatttcacctaaaatgttagcattatccaaaatatcacttcaacatcttatcaaaataaaaattattaatgagaaaa

SEQ ID NO: 368313 - DNA, 1453 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaactcgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctggtgagttctgtggtctgcatgtccatgtttgggacattctgggaagggtggcccaggctgtgatttgccatctactgcaggctatggatggtattcagaagggaggggagatgctgtgtgcgtgttctgaagggtttcccactaaacagatcaaccctctccataactatttgatttttactttatctcctcgttgacttcacagtgtcagtgcagtttgtgtaaacatctctatggggtgatgcatgcagataaatgtttatgtgaacatataaagtctgcatgtgtgggtgaacactccacatcaggtcattgtccatcattacatatctgtggtgtctggctcattcgtctcgttttctgtcattttacctacttttacctgaagtacaatgactatttaataactattaaatgtttcatttcaactacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtg

SEQ ID NO: 368314 - DNA, 1159 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtctccccaacaggtacaagatatcatcctgccacttgttcgaggaacccatcccaatccaattcctgaacagacagggccctgccattcattcccgccaggtgacctgttgtttgttaaaacagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccaggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgattgttcccaaaccagtgggatgtttgcacgggttactaaccggttaacttccttcttataacacatgtcacctgatggtcctaataaagcgaagacaccggttaagggagccagaaatggggccacaccagatggaaggggttcgccggcgcacggctttatccgggtctctttttgccc

SEQ ID NO: 368315 - DNA, 845 bp, Homo sapiens
gccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggaactgttggaaactactgaaactggccgacctgatcttcaaaatgtgcccctaggaaaggtggatgccaccgtgttcacagacagtagcagcttcctcgagaagggactacgaaaggccggtgcagctgttaccatggagacagatgtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagcca

SEQ ID NO: 368316 - DNA, 1384 bp, Homo sapiens
gacagagtcttgctctgttgcccaggctggagtgcagtggcgcgatctcggctccctgcaagaatctgcctcccagattcacgccattttcccacctcagcccctggagtagctggaagtacaggctcccgccaccacgcccggctaatttttttatatttttagtagacacggggtttcaccatgttggccaggccggtcttgaactcgtgacgtcaggtgatgcacccgccttggcctcccaaagtgctgggattacaggtgggtgcctggccaaggggctgatatttcttaagggctttccccaagaaggaaaaagccaaacctactcaggcaaatcttgtttatttattcttctaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctgataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtacctgtaagagtaaa

SEQ ID NO: 368317 - DNA, 478 bp, Homo sapiens
ctatacacataaagtagtttcagaattgttagcctatatccctgtgggaaacactttctatgaaatagattacagcatttatgtacagttctttttatctttaggcatagagtatctaagcaagataatgtttcccacagttactgtttgtattcccttttaggcactctccccctaaatcttagttacttttgtttgtttatattttaggtatgtgaaacataatggatctaagagtcagagttacacaaaaagatatactcagagcagagaaatgcaaattaaaaccccaatgagatatcacctcatgcccattaggatggctactgttaaataaataaatagataaataactgaaaataaaaggtgttggcaaggatgtgaagatatagagaaattggaacccttgtacactgttggtgagattgtaaaatgatgtaactactgtggaaaacagcatggaggttcctaaaaaaat

SEQ ID NO: 368318 - DNA, 4664 bp, Homo sapiens
  misc_feature (3)..(5): n is a, c, g, or t
  misc_feature (7)..(7): n is a, c, g, or t
ggnnnangctccggctgggacagggcggcgggaggcccagggagaacggggaagggacatttagtttggtgagttacgggggcacaccttagctcagaacctgtttttacccagtaccctagggctttggttctttgtcgccgtccccgttggagttttttctttgcctttcagaagcccgtgcactctctttagagtgcagggctgacgggcggtccagccctggccaagtcatggagcgtgaatctcccaagtcagtgttcccgctgaggagggtcggaaccggggaggacgccctcccacccctgctgacctactaacattcatcagcgagccttctttttccccctcgcagagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctttttttttttttttttttttttttttttt

SEQ ID NO: 368319 - DNA, 4347 bp, Homo sapiens
  misc_feature (3)..(5): n is a, c, g, or t
  misc_feature (7)..(7): n is a, c, g, or t
ggnnnangctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtc

SEQ ID NO: 368320 - DNA, 4833 bp, Homo sapiens
  misc_feature (3)..(5): n is a, c, g, or t
  misc_feature (7)..(7): n is a, c, g, or t
  misc_feature (4833)..(4833): n is a, c, g, or t
ggnnnangctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtcaaaaaaaaaaaaaaaaaaaaaaaaaaaagaagaaaaaaaacagaaaagaaaaaaaaaagaaaaaagataaaaaaagaagaaaagacagccgccacgaagaaacagaaaagagacaacaacaacgatcaccaaaaacacaaaccaagaccgcaaaagcacacacaaacaacacacacacacacaaaaaaaccattattaaaaaacattgtagaaaaactaatcatgagacaaaatgtgacaaacatgagaaaataaaataagaaaacacgacacaaaccaagagaacatagattatgcataataaaggaaacggggacataagcagagaatcaaagacacagaacaagaacagcgccggcagcgcgcacagagcggacgaagagagaagagaaggtagagcgcggaaccaggacggacgagcgagcgacgcagacaccgacggaaaagacaaaaagcaagaaaccgcagaaggagaagcgacgctan

SEQ ID NO: 368321 - DNA, 3419 bp, Homo sapiens
cctgttgcaaccgtatctggctctgaattattacctttctccaaaccactgaagtacttcagagatgtgtttattgtacatccaatattctacctgactaggaggatagattgggttggacacacttttcccagacttttgtggtataattttgacctaatccccctacctatccaaaaggcctatgggatatatttttatccacctttgatataggtattatcaatcagatatttttctaatatgttatttactttgttttagtgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctttttttttttttttttttttttttttttt

SEQ ID NO: 368322 - DNA, 1490 bp, Homo sapiens
  misc_feature (3)..(5): n is a, c, g, or t
  misc_feature (7)..(7): n is a, c, g, or t
ggnnnangctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataacgtatgtgaaacataatggatctaagagtcagagttacacaaaaagatatactcagagcagagaaatgcaaattaaaaccccaatgagatatcacctcatgcccattaggatggctactgttaaataaataaatagataaataactgaaaataaaaggtgttggcaaggatgtgaagatatagagaaattggaacccttgtacactgttggtgagattgtaaaatgatgtaactactgtggaaaacagcatggaggttcctaaaaaaat

SEQ ID NO: 368323 - DNA, 449 bp, Homo sapiens
ctcgctggatcagaaagacagaagaaaaccaaggctgaaggggatcgtctaaaagagggtaagagagtaattaaggtcacagttgtagattaaaaacttctagtactcttgttggtattgttggtgttttcgactgggatttgagatcacattctaacagtagctacgattcagatttgaggctgagttcagaaatagcgaaaaattgtttctttcccttgctctcattctctaattcaggtatgagatttggatctggcctttggtttgatttcatctggtccaggcaagttttagttttagttttgttttgttttgttttaccccaactatttataattaaaatcagtatcctgattctgtcattttaagtattcaccatcccttccagatgttgtcacatataaacctcagcccaatttccatgccttcattcaagttgttgaatt

SEQ ID NO: 368324 - DNA, 422 bp, Homo sapiens
gggaactaggctagctatttatttcagatacttaaaacaaatgtatgcagagccactgttgtaaaggaacagagatattgttaatggagaagtgcctgtgagacttgatgaaatagtgcctaaggaactccatttgcttgtttctcttataaatcattatcctgatttttttccagcaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggtaaactatttcctagggcagtatttgttcatgtctacagtctcttaaactgaatgggaa

SEQ ID NO: 368325 - DNA, 4377 bp, Homo sapiens
  misc_feature (3)..(5): n is a, c, g, or t
  misc_feature (7)..(7): n is a, c, g, or t
ggnnnangctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctttttttttttttttttttttttttttttt

SEQ ID NO: 368326 - DNA, 4562 bp, Homo sapiens
  misc_feature (3)..(5): n is a, c, g, or t
  misc_feature (7)..(7): n is a, c, g, or t
ggnnnangctccggctgggacagggcggcgggaggcccagggagaacggggaagggacatttagtttggtgagttacgggggcacaccttagctcagaacctgtttttacccagtaccctagggctttggttctttgtcgccgtccccgttggagttttttctttgcctttcagaagcccgtgcactctctttagagtgcagggctgacgggcggtccagccctggccaagtcatggagcgtgaatctcccaaagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctttttttttttttttttttttttttttttt

SEQ ID NO: 368327 - DNA, 4450 bp, Homo sapiens
  misc_feature (3)..(5): n is a, c, g, or t
  misc_feature (7)..(7): n is a, c, g, or t
ggnnnangctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgtttgggaagatccttctgtgctagagggagaaataaaatttcaacctgtgttcctcagcccctgaggaagctattaaggggattcattacaagtacct

SEQ ID NO: 368328 - DNA, 1959 bp, Homo sapiens
  misc_feature (3)..(5): n is a, c, g, or t
  misc_feature (7)..(7): n is a, c, g, or t
  misc_feature (1885)..(1885): n is a, c, g, or t
  misc_feature (1891)..(1891): n is a, c, g, or t
  misc_feature (1951)..(1951): n is a, c, g, or t
ggnnnangctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcccgccgnaacgtntcagaactgaggcaatgctgtctgaaaaaactgatgacagccaactttgaactaagatcncgacgctg

SEQ ID NO: 368329 - DNA, 701 bp, Homo sapiens
atttggccctcgaaggccaagatttcggcacaagggggcaccgaggatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgaaaaaaaagt

SEQ ID NO: 368330 - DNA, 404 bp, Homo sapiens
ccacaaagaacttgggattctttggccttactggagttttgttatagctaacaccagtctgtattaattaagaaggcactattaatgagggacggaaaaatctacctgtacacaaaattctgtactttaacagcatcttcaaataaacctttaaaggataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgaaaaaaaagt

SEQ ID NO: 368331 - DNA, 3859 bp, Homo sapiens
tctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgaaaaaaaagt

SEQ ID NO: 368332 - DNA, 3806 bp, Homo sapiens
tctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgaaaaaaaagt

SEQ ID NO: 368333 - DNA, 3805 bp, Homo sapiens
tctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccactttactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgaaaaaaaagt

SEQ ID NO: 368334 - DNA, 3411 bp, Homo sapiens
tctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtttatgctgtacagcataaactatttgtaagtggtcaaaaccagaagcaaccagagcccctcagcagaatgggaaaatatgaaatatacagtaataagaacaatgaacttcaatttacacatgtatacgttcacatcataa

SEQ ID NO: 368335 - DNA, 1258 bp, Homo sapiens
tctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtcca

SEQ ID NO: 368336 - DNA, 377 bp, Homo sapiens
agagatcatctagagaaacctcccaaaaataaggcataccatccctctgatggttgaaacacacttagttctgggcagaataaatgaaaacaaattcatacctcgatatattgcagtgaattttctgaacttcaaaaacaatgagaaaatcttaaaagtcactgagataaatgacagattgaggaaaggaagcaggcgggcagctggtggtcttccaagcactatagctgatcagcaaccagagattccagagaaacatggaatgataccttaaagtgctgaggctaactaactgctgagcacaaaggatattttttcaggcacacacagggattctgaaagtgtaaagacgagtcccaggccctcatttgaatatt

SEQ ID NO: 368337 - DNA, 389 bp, Homo sapiens
gcttaaaagaacaatcacttgattgtatctcgtggtcctaggggtggatgaggctcagctgcatgactgtcacttggggtctttcatgtggttgtagtcagatggcggctgagtcaggagtcacctgaagatttcatccatgcctcttacctgggctgcaatggcgaggacagatggaggctggtccattgtgtctctctccatgcagcctccttgtgtggccagcctgaattcctcagtggtgatggccttccccacagcaagtggtccaaagtggaagctgccagtcctcttctaggaactggcccggtgtctccttcatcattttctattggttaaaacagtcacaggtggccagacgcggtggctcatgcctgtaatcccagcac

SEQ ID NO: 368338 - DNA, 2011 bp, Homo sapiens
tttctcaacagcccacctctttggactaacactaaactggaagataaaacctacacccagatttaaacacctggatccaccgatctggaacccaagttaagactgtgcagggcattcagccagcactgcacacccctcagaagttcactgactttcgttttgcacctccaggtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggcaaaaaaaaaag

SEQ ID NO: 368339 - DNA, 2207 bp, Homo sapiens
tggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggcaaaaaaaaaag

SEQ ID NO: 368340 - DNA, 689 bp, Homo sapiens
tggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtgagtgcttggggttgcctgaacgagtcctctagagccacagtaagctccctgaagaagccaggcccacacccagggattgtggctgcccgggctccctgcaaccctgccagctgtcgactccagtcagaaaaaggcctgtgcctggctctatgtcaggcccgggctgaggactccccaggagggaacaagctttttaagagtcaggggtatgtggtttcagatctcagctctgcaggttactggctgtgtgaccttgggcaacttacttcacatcttcgagccttagtaaaatccatttaat

SEQ ID NO: 368341 - DNA, 2225 bp, Homo sapiens
tggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggcaaaaaaaaaag

SEQ ID NO: 368342 - DNA, 2074 bp, Homo sapiens
tggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcattgtttggtggccccaatgtgagtcgctgtaaaaaatgctgccgttactattttctaagaaatgacttttctgtgaaccaacagtaacaaaaacctcagtaaccaaaataaagttctatattttaaaaaaggcaaaaaaaaaag

SEQ ID NO: 368343 - DNA, 1961 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368344 - DNA, 2204 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcagaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368345 - DNA, 1795 bp, Homo sapiens
gtcgtctcaggaaactttttaatgaaagtgttggccacggtggtgtgtaggtggctgagctcagattgcagctgctgagacaccagccacttaccaagagaaagccaggctgcttcaaacccagggcccgcggcaaaaaagcatcacttccggccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcagaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368346 - DNA, 2236 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368347 - DNA, 1192 bp, Homo sapiens
cggggaacgcccctctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368348 - DNA, 2459 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcagaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368349 - DNA, 2318 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagagacgcggctgttcggcggtcctcgcgcgctggccatcaggtgagcagggcggtgggcgcggccgcggtcccccacgtgcccgcccgagccgccgcccacctgcccgcctttcgccctgcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368350 - DNA, 675 bp, Homo sapiens
tccctgtctcccctgacactcgttcctccagaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368351 - DNA, 2312 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcagaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368352 - DNA, 842 bp, Homo sapiens
tccctgtctcccctgacactcgttcctccagaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368353 - DNA, 2383 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368354 - DNA, 824 bp, Homo sapiens
tccctgtctcccctgacactcgttcctccagaagcccggtaaaccccgtccttacgagccccgcccctagctcttctactacggaggggaactgcagagccagaagagcacggagcagcaactcgcagcccaattggtgacgctgcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaa

SEQ ID NO: 368355 - DNA, 1532 bp, Homo sapiens
cttttttttaaggacgaatatctcatttatttccctgcagctctcatcccctgctcatccaagcctccctccttccagatgaataggaacaggttacagctgacccagtttcactcccagcttcagaagatgaatcacggtgggttggcggacaaggaatggggcaagctggggcagcgcggaaggcagtgctgttttcaggaggcctgacctctgtggccagagtcccgtcagcaccgcttactgcaggccaagatgcctccctcctccagaatccgaccgcggagggagcttccagtccaggagcctgctctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatctaataaaaggaaagtgtcgctttc

SEQ ID NO: 368356 - DNA, 2238 bp, Homo sapiens
aaaaaccataaagaaaagcaaaagaatgatttgtagttaattctggggatggagggtacacaggaggacttggaaaagcctggtaacattctgtttcctaagctggtgttttctttaaactatttctaatactctagtatgtatatttcttaatttaaaaaaagtttcaaatcagacaaaactctctaagccaaaaaaaagtccaccacaagtcattaaataaagcaaataataaaacagtatgtaagttattaatttttgttaagaaattacatatgcatctacatttttgtgtttaaatggacatacaagtagtttgagaggataaacacgaaaatgtggttttggggaagtaggatttcaggaaaatttctgcatcacctgtattttttttaaaattttgaaatccatgagcatttatcagtcagactcacattatgagattatacttcttaaaatttttattgatgtaaaagaattgtacatatttatagggttatacttcttttatctttactgttgaataaggagcctaaaggtagggtccatgttttgtacatacttctctgtattcttataataagaattggaaaaaaaataaaccaaaacaactaaaaccaaaaaatgtgtgggaagtcactaacaatgtttagaaatattaagtgagaaaagcaggttaaaaggcagtattttacatatttaatattagtgcccttagtacgtgtattctgcgtcttaaaatgaaaatgctccactgtcaatggttgttttctcttggtattgtaatcagtcggtagtttttattttctttgtattttccttatttgtgtgtattacataagaaagcagaaaaaaatagaatatttataattattaaagattgaagttcttaggtgctttcagtaacattatcctcacctttggggtcgtggctgcctatctggagtgctgtcttgttaaggattaagatgagtggctgaggatttgcacttctgtaagtggctgcttcatcctttgacacctgcgctgatcatttgtgtgcgctgcacctccttcaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatctaataaaaggaaagtgtcgctttc

SEQ ID NO: 368357 - DNA, 642 bp, Homo sapiens
atttcaaagtttggaaaggccaaggttcggccctttggaattccaatgccaacgttgtaaaccccggcaaggaattgaaaccccttcctaaagggcgaattgggaccgggccccccctcgagttttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368358 - DNA, 946 bp, Homo sapiens
caaaaacaaatatggatcattgcttttattggataaatataacttggtttatattatacaatttttttttcatcttttattaactgtagcattttctaagcttctagtctgaaaaaaatagactgaatattttttcttacactttgacagagataggctttaaacattttttatgagcacaggtgaaaaagcaggaagattgtcagttaagtcgataataattccaaatgtcaatcttatcttgctgtaaaatttcactccaaccttgttgggtttagccagtatcagcttgaggatttgtccacaaaactcctgtgggaggatggacgcccagtggcctggacagctcactttccaccctttcattgcctgtctctgtctcctaggtttgtgagttgcctgctggagcagcctgaagtgttagtcaccggtgcaggaagaggacatgctggcaggatcattcacaagctgtttgtgaatgcccagagggtatgtgagagtcattattgactccatcataatctctccaaacctctacttgggaagaggctgttttagttcccacacgtggctgatcacactcatgtcacctgagtgtaagtctgggcattgggtttgaacactgaagaaacaatgacttctgagtcttcgaaatccatttgatttcttacatgttgaattaaaatgataagtatattctaggacctaaattttaaaaattagaagagtccaaaatccattgttatagaagctggcagggagtcagttagcaatggccagtgctgtgctgtgggaaaaaatgtttactcacaggtactttcaaatgagaatggagttcagttttaccatctttaaaccccatgtagggcaaagtggagtcacaactcagcttgaattataaatataattgttcttgtaatggtgaggagatctacctttgaggttt

SEQ ID NO: 368359 - DNA, 847 bp, Homo sapiens
  misc_feature (8)..(8): n is a, c, g, or t
  misc_feature (667)..(667): n is a, c, g, or t
gcacgagnaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaaggtcagatctatttgctggtgtctctaaatgactatttactttgaaacctctattttccagccctttgctgcatttggcacatttgaattaaatgttttttaaagttacgtataatctataaacatcaaatagcatttggaagaatttggatttaaatctgtggcaaatgatatatgtaagacatttgtgaaatgtttaataaagttatatatatgtgtgtgtgtatatatatatatataaaatgtcattcttgtgagtgattctttgtgagtgaagttgcttctcttttgccttctcccttggaatgttaaaacatgtttttaaaagttttttatttggtcagagaaacattgcagtgaccatcttctttggtagcatattttgcttactaatgaggaaattctagtacttaccattgacttactgtagttaacaactatttcactcagtttttgtattttataatatcactaataacatcccccttcccttttaagctttaactntggcggttgaggggtgttttgaaggggaattccttgggagggggggaccctcttctcccgatgggggttgttctccccgccctttttttgttctgcgcccggtccggggggcgccaccttttttgtctgggctcgcaaagggggggcccacaatcgatatatcttgtcattggtgggcca

SEQ ID NO: 368360 - DNA, 655 bp, Homo sapiens
cccgggctgcaggattcggcacgagctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttaatttctagtttcatggagctcaagatgtcttgtgtctgtgtggctagatggcctctgcttggtaatcttatttttagagctattccccatataattcacaggttgggtatactggagatatcttgtctgtgtg

SEQ ID NO: 368361 - DNA, 4477 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatctaataaaaggaaagtgtcgctttc

SEQ ID NO: 368362 - DNA, 4216 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaactttgctctggggtttaggttttttttcgggcaaaacgcacaacgaaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368363 - DNA, 4269 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagtaagtttgatgtagtgtcagaatcttgccaagtgttctcctcagttggcaaaaataatttttaagatgcgttttcaaagggctttgcttttttgccatctcgcaatgtatgcctcttccttttctaccgccaggaaatcattcaccagattactaatgtggaagctctcattgccagagctcggtcactaaaagccaagtttggaactgagaaatgtgaacaggaggaggtagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368364 - DNA, 2933 bp, Homo sapiens
aaaaaccataaagaaaagcaaaagaatgatttgtagttaattctggggatggagggtacacaggaggacttggaaaagcctggtaacattctgtttcctaagctggtgttttctttaaactatttctaatactctagtatgtatatttcttaatttaaaaaaagtttcaaatcagacaaaactctctaagccaaaaaaaagtccaccacaagtcattaaataaagcaaataataaaacagtatgtaagttattaatttttgttaagaaattacatatgcatctacatttttgtgtttaaatggacatacaagtagtttgagaggataaacacgaaaatgtggttttggggaagtaggatttcaggaaaatttctgcatcacctgtattttttttaaaattttgaaatccatgagcatttatcagtcagactcacattatgagattatacttcttaaaatttttattgatgtaaaagaattgtacatatttatagggttatacttcttttatctttactgttgaataaggagcctaaaggtagggtccatgttttgtacatacttctctgtattcttataataagaattggaaaaaaaataaaccaaaacaactaaaaccaaaaaatgtgtgggaagtcactaacaatgtttagaaatattaagtgagaaaagcaggttaaaaggcagtattttacatatttaatattagtgcccttagtacgtgtattctgcgtcttaaaatgaaaatgctccactgtcaatggttgttttctcttggtattgtaatcagtcggtagtttttattttctttgtattttccttatttgtgtgtattacataagaaagcagaaaaaaatagaatatttataattattaaagattgaagttcttaggtgctttcagtaacattatcctcacctttggggtcgtggctgcctatctggagtgctgtcttgttaaggattaagatgagtggctgaggatttgcacttctgtaagtggctgcttcatcctttgacacctgcgctgatcatttgtgtgcgctgcacctccttcaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368365 - DNA, 1944 bp, Homo sapiens
caaaaacaaatatggatcattgcttttattggataaatataacttggtttatattatacaatttttttttcatcttttattaactgtagcattttctaagcttctagtctgaaaaaaatagactgaatattttttcttacactttgacagagataggctttaaacattttttatgagcacaggtgaaaaagcaggaagattgtcagttaagtcgataataattccaaatgtcaatcttatcttgctgtaaaatttcactccaaccttgttgggtttagccagtatcagcttgaggatttgtccacaaaactcctgtgggaggatggacgcccagtggcctggacagctcactttccaccctttcattgcctgtctctgtctcctaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368366 - DNA, 1558 bp, Homo sapiens
gggacattttcatatctttattatgttaattcatctgtccttcaaaagcatctgagtttagcatttgacctgcttttgactttagcatttgattcttttccaggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368367 - DNA, 1358 bp, Homo sapiens
gacccacgcgtcggcctctctgacctgcagtcacccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368368 - DNA, 913 bp, Homo sapiens
cggcacacagggctgggtaggaggggttggaggggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368369 - DNA, 1042 bp, Homo sapiens
agatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368370 - DNA, 3206 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368371 - DNA, 3191 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggtatgtgagagtcattattgactccatcataatctctccaaacctctacttgggaagaggctgttttagttcccacacgtggctgatcacactcatgtcacctgagtgtaagtctgggcattgggtttgaacactgaagaaacaatgacttctgagtcttcgaaatccatttgatttcttacatgttgaattaaaatgataagtatattctaggacctaaattttaaaaattagaagagtccaaaatccattgttatagaagctggcagggagtcagttagcaatggccagtgctgtgctgtgggaaaaaatgtttactcacaggtactttcaaatgagaatggagttcagttttaccatctttaaaccccatgtagggcaaagtggagtcacaactcagcttgaattataaatataattgttcttgtaatggtgaggagatctacctttgaggttt

SEQ ID NO: 368372 - DNA, 2489 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagccagtgatcggaacatgtcggcaatatagaagactcgagtagagcaagataatgagcccattaacagtaaagtgattg

SEQ ID NO: 368373 - DNA, 1504 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggtcgacgcggccgcgaatttagtagtagtagggccgc

SEQ ID NO: 368374 - DNA, 361 bp, Homo sapiens
actaaatgtactgagtcctctctggtcaaattgttaaaatataaaaaatacctttttaaagaaattacataataataggaaaaaaggtgtgctgttgtatttagaagctttctccctacttcctaggtttatttccaaagttgaagaagtcttgaatgactggaaactgattggaaactctttgggaaagccactcgaaaaggtcagatctatttgctggtgtctctaaatgactatttactttgaaacctctattttccagccctttgctgcatttggcacatttgaattaaatgttttttaaagttacgtataatctataaacatcaaatagcatttggaagaatttggatttaaatct

SEQ ID NO: 368375 - DNA, 547 bp, Homo sapiens
gttttgatttcttatcaatatagctaaaaattatggtagtatagaaaataatcatatctgaagcaattttactaaaactaagctttcttttctccttactttatttgatagattagcaagtggacccccagatctgaggtgttgtttactgcatcagaaactacaggtaaagatttctcaatgacatggataaatgtggtcttgatttaatcagattattctaatactaaatgtaataatgggttacatgctgttctcatggtgctgctgtaggttgcctatagtcagtagtcactgcaattcacaaggtcctgagaagtggagagtgaaaattaaatattcaagcagtaggtagatttttatttttctgtaactaattcaactataaatgttatttctcttttcttaagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaac

SEQ ID NO: 368376 - DNA, 508 bp, Homo sapiens
agttccattttcacctgcttaggttggtgatataattaatatttatttctgttctttttatagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctggtaactaaatgttctgtctttataggtctatatgcagaatcatttattcattatatagccagttccttttatgtggtaggcagtgaccttggaatatacaatgagtaaaacagttaccacatttagaaaattcctactagtttagtggtgagaaggaaagtaaatagtagttgtgataccatgttgcatgtgagaaatctggcaagggggctgtgagagcacagcaggggtgcatttgtctctgtctgggcaggtgaaaggggggtaccgagctg

SEQ ID NO: 368377 - DNA, 379 bp, Homo sapiens
aaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatctaataaaaggaaagtgtcgctttctgtggcgttttctttcattttctcccgctgaggcatttcagtctaatttcatgtggttttgtgctg

SEQ ID NO: 368378 - DNA, 4189 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368379 - DNA, 4107 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368380 - DNA, 1598 bp, Homo sapiens
gatcgatgaaagggcacctgcaagtctaaagtctctttggtgagaacactgtacatccgctgaggcagagctttgtagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctat

SEQ ID NO: 368381 - DNA, 3499 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactcttcgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaatacatatctattttttaccaaaaaaaaaaaacaaaaacaaaaaaaacaaaaaagaaaagatagacaagggaaacacaccgaagagaataagaggagagcagcgagaacaaagaagaaaacacgaaaaaggaagacgagagaacaacgaaacaggagtcaatagggagacagaacagagagacagagcaaaggagcggagcaaagcgatagacgaagcgaggcaacagagaggggaacagagcgagcggatagagagagagcggggcgaacgagggcacgagcgggcgaagacaggcgaaatgac

SEQ ID NO: 368382 - DNA, 1059 bp, Homo sapiens
agcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaattgccgtctaggagcgtaatcggtaccgagctca

SEQ ID NO: 368383 - DNA, 1006 bp, Homo sapiens
gcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgcaagaaagtgaatctcactactacctactcccctaaaactacctattttgtgctggctggcttgcctgctacctagtgccgactgctcccaggcaagtcccctgctgcttacagcccgcagcttttggggtccctgaggctgccctgagaatgtgctgaggtccaggatcagggtattggcatctatttaaatcgaaaaataatatatttattccaaaaagcatcctaagtgcttgcaccctagaatcaatccctccttctctggcttggcacccacagctcaggcccatcaacccccacttctggaggggaatgttcctgagctggctgcagatctgtgggttagcttctgcttagcaggactgtggagatgcttccagcttcgctgtcctttcctctggctcctgtatcttactgttcagctgtgttaaatatggacgcccatcgatgcgcttcctataatagcagatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtaaccgaaaataaagatgcgtggtgacaaagaaaaatgtgga

SEQ ID NO: 368384 - DNA, 254 bp, Homo sapiens
actattcaataggaagagcattgtcttttcaacaaatggcacccagacaactggatagataaccacatgcaaaataaagaagtttgtcccttacctcacaccatatacaaaaattgattcaaaatggatcaagatctaactaacagcctgaactataaaacccttacaaggaaacatagaggcaaatcttcatgactttggatttggcaatggattcttaggtataatgccagaagcacaagcaacaactgaaa

SEQ ID NO: 368385 - DNA, 1238 bp, Homo sapiens
ggaccggaagtggcgtccggcgcaagcgctggcagccgcacagcccattgggaggccgaggggcgcggccgtggggtggggagtccccggcaccccaggtccgcgccatgggccgcaggagggcagcgcgcgggccgggggcggaaggcggccgccctcggcacctcccgacgcgctccctggaggccttcgccgaggaggtcggcgccgcgctgcaggcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcgatcccttcgatgtggattcagggagagagtttggaaaccccaacaggcctgtggccagcacccggctgccctcggacactgatgacagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggcc

SEQ ID NO: 368386 - DNA, 750 bp, Homo sapiens
ggaccggaagtggcgtccggcgcaagcgctggcagccgcacagcccattgggaggccgaggggcgcggccgtggggtggggagtccccggcaccccaggtccgcgccatgggccgcaggagggcagcgcgcgggccgggggcggaaggcggccgccctcggcacctcccgacgcgctccctggaggccttcgccgaggaggtcggcgccgcgctgcaggcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggtgagtccagtggccccacagcagtgtgacccggcggcctgctgttcctgctatgctcccagcatcatgtttcctgccgacagaccccaggaggagcataagggacggacaggggaa

SEQ ID NO: 368387 - DNA, 516 bp, Homo sapiens
ggccgccctcggcacctcccgacgcgctccctggaggccttcgccgaggaggtcggcgccgcgctgcagggtgagcgaggcgtgatggggagagcgggtcagggtttgagggcctgcccgggggtcccacgctgaggccgagtgcccttctctctctcgtgcagcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacaggtaggcgcgggaggcctgcccgaggtcgtcttcatttccagcgcgtggttcccttcagggatggtttagtggcacttgtatgtcgcacccacatccacacccacgtgggcagggaacgtctgtctagtttgc

SEQ ID NO: 368388 - DNA, 1115 bp, Homo sapiens
ggaccggaagtggcgtccggcgcaagcgctggcagccgcacagcccattgggaggccgaggggcgcggccgtggggtggggagtccccggcaccccaggtccgcgccatgggccgcaggagggcagcgcgcgggccgggggcggaaggcggccgccctcggcacctcccgacgcgctccctggaggccttcgccgaggaggtcggcgccgcgctgcaggcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccttgcgcctgttgccctacctggtggccgccaaccccgtgaactatggccggccctacagactttcctgcgtggaagcgtttgctgccaccttctgcatcgtaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcgatcccttcgatgtggattcagggagagagtttggaaaccccaacaggcctgtggccagcacccggctgccctcggacactgatgacagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggcc

SEQ ID NO: 368389 - DNA, 952 bp, Homo sapiens
  misc_feature (1)..(1): n is a, c, g, or t
  misc_feature (29)..(29): n is a, c, g, or t
  misc_feature (798)..(798): n is a, c, g, or t
  misc_feature (825)..(825): n is a, c, g, or t
naacttaggctaggtacgaggctgggtgntaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccagacttacctgggctttggtgcattatcagttctagactctctcttcggtgagagtggggagtgngaccacatggattgggaacggcctgcntggcgtgtacgcacaaaaacctatctggtagggggggcgcggcaggaccaggacgcgaacccctttttcacggatgagtccggcccggggaaacctgggggaagcccacacgtcaagcgggcagaca

SEQ ID NO: 368390 - DNA, 1948 bp, Homo sapiens
ttcttcaaaaggggcctccccctacaactggcttggcccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368391 - DNA, 2278 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaaaaaaaaaaaaaaaaaaaaaaaaaaaaaaaaaaaaaccggggggaatctaattatcggggggggggacaaacaggggttaatgaagaggggacacgtgggtcaactgggtgtgttcctggagacccactttctctgctgacacacagggggtgaaaattcggaggggccccccataaaggggggcgcagatataaatcggaataaccaccggcgtaaccgcgattag

SEQ ID NO: 368392 - DNA, 2286 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368393 - DNA, 2115 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagagttttactcttattgcccagactggagtgcaatctcggctaactgcaacctccgcctcccagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368394 - DNA, 1555 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcgtccccactgttggctagtactaacggggatcctcatagagt

SEQ ID NO: 368395 - DNA, 1974 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368396 - DNA, 1687 bp, Homo sapiens
gagctcgggtaccccacgcgcaccgccggttcaaaaaggccttcgatacgggataatcctatttattacctcagaagtttttttcttcgcaggatttttctgagccttttaccactccagcctagcccctaccccccaactaggagggcactggcccccaacaggcatcaccccgctaaatcccctagaagtcccactcctaaacacatccgtattactcgcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368397 - DNA, 1522 bp, Homo sapiens
  misc_feature (1)..(1): n is a, c, g, or t
  misc_feature (29)..(29): n is a, c, g, or t
naacttaggctaggtacgaggctgggtgntaagatggcggcgctgagggctttgtgcggcttccggggcgtcgcggcccaggtgctgcggcctggggctggagtccgattgccgattcagcccagcagatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368398 - DNA, 1479 bp, Homo sapiens
gctggaagcctccaccttggaatgatgtgggctgtttctttgcttgggtacataacagctcactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368399 - DNA, 1895 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaaatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368400 - DNA, 1218 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagaggtaagagtgggaggaaaggataggaatagggaaggaagtgcaggaagtagagaaggtataaaggagacaggagattaaaagaagagagagaacatgggagaacatttagagggggaaggtatgtttaacttgg

SEQ ID NO: 368401 - DNA, 1581 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368402 - DNA, 395 bp, Homo sapiens
ttcctccaggagccacatatactgccattgaggctcccaaggtaaggagaggaggggaaggaaaagaccatatgtagagtaggtagctaaagatagatgtttaacaaatagctcattcatcaatgagagagaaaacagaatgaatagaggttttgttggcagagaaaaatactcttcatgttaatacagacacccaaccttcttccttgaacagggagagtttggggtgtacctggtgtctgatggcagcagccgcccttatcgatgcaagatcaaggctcctggttttgcccatctggtaagaatcaatcccagtaactataactccaatgaattaaacctgaccttggttgaggtttttatgaactcttctttctcctcccaccttgcaagtc

SEQ ID NO: 368403 - DNA, 383 bp, Homo sapiens
ccggcttccccaaatgtccagcccaggcctattttccctgtggccactggagggcagtgctggatgatggaaactccaaacctgtatcgctgggggagggggtgctgagagggctctccttagtgaaggctatgccacattcagtagcacttccgtttggcttctaggacctaccccttgggcttatggatgacatttatcagttttctaagaacttctctcttcggcttgatgagttggaggaggtaagctaggagtcaatgggaaaaatctctcccccacaagaagggctagagaaatacagagatatttgaagagtgtgaggaagagtattaacacaccagttttcttgatcaatagttgctgaccaacaataggatctg

SEQ ID NO: 368404 - DNA, 96 bp, Homo sapiens
ctgttcttctcttgctctgtctcatcttcttgaggtacctgtgccgggtggaggagatgcgccagtccctgagaattatcgcacagtgtctaaaca

SEQ ID NO: 368405 - DNA, 336 bp, Homo sapiens
ccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtac

SEQ ID NO: 368406 - DNA, 2052 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368407 - DNA, 1936 bp, Homo sapiens
ggaagcgccgcgcgtttccaagatacgcaggcgggctcggcgagagagcacgaagtatctgccccacgcaggaacggcaattttcccttgctcgctcctagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368408 - DNA, 2276 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtagtatgtaatgtacatgtggggtgacagagataatgtgaagtatgtaataaaaggggagactattttaataaactacggcgtcgtgcaggacccatgaggcctcagaacagacaacgaacagaagaaagcacaaaaaaacaaaacagaaagaggcgagaacgaacatcaggggggggagagaacaggagagagaaaaaggacagagaaggggcacaggcagggacacgcgggcgagacggatgaagcagaagaggaggagaagcgggccgcaaacaacaaagaagacgggaaacacaaaaagcgaacagaggcaaacag

SEQ ID NO: 368409 - DNA, 1995 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368410 - DNA, 1881 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggtaagaatcaatcccagtaactataactccaatgaattaaacctgaccttggttgaggtttttatgaactcttctttctcctcccaccttgcaagtcttaactaacattgttgccatctcaatctccct

SEQ ID NO: 368411 - DNA, 1616 bp, Homo sapiens
  misc_feature (3)..(3): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368412 - DNA, 1584 bp, Homo sapiens
ttaggagcgcagcgggtgacgggccgtatcgcctttcgctcggcgtcgcggaactgtcagaccttcgtgccgctgttccgtacaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368413 - DNA, 1561 bp, Homo sapiens
  misc_feature (1)..(1): n is a, c, g, or t
  misc_feature (29)..(29): n is a, c, g, or t
  misc_feature (129)..(130): n is a, c, g, or t
  misc_feature (132)..(132): n is a, c, g, or t
  misc_feature (134)..(134): n is a, c, g, or t
naacttaggctaggtacgaggctgggtgntaagatggcggcgctgagggctttgtgcggcttccggggcgtcgcggcccaggtgctgcggcctggggctggagtccgattgccgattcagcccagcagnngngntcgagggcagctggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368414 - DNA, 1464 bp, Homo sapiens
gcgacccctgagcagtgttctatgtgctgagcggcgggactgagctgttgagttagagccaacatgaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368415 - DNA, 1375 bp, Homo sapiens
  misc_feature (3)..(3): n is a, c, g, or t
  misc_feature (1221)..(1221): n is a, c, g, or t
  misc_feature (1248)..(1248): n is a, c, g, or t
ggnacagggccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccagacttacctgggctttggtgcattatcagttctagactctctcttcggtgagagtggggagtgngaccacatggattgggaacggcctgcntggcgtgtacgcacaaaaacctatctggtagggggggcgcggcaggaccaggacgcgaacccctttttcacggatgagtccggcccggggaaacctgggggaagcccacacgtcaagcgggcagaca

SEQ ID NO: 368416 - DNA, 1297 bp, Homo sapiens
ttcttcaaaaggggcctccccctacaactggcttggcccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccaccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368417 - DNA, 509 bp, Homo sapiens
  misc_feature (1)..(1): n is a, c, g, or t
  misc_feature (29)..(29): n is a, c, g, or t
naacttaggctaggtacgaggctgggtgnacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 368418 - DNA, 587 bp, Homo sapiens
cgacggcagtgaatcgagactcgggacccaccagtcctatagatcagtatagcaatattctgaattcaaaattctgttgttaaggatggtgtaaccatatatgacaaggcttttacaaactcctttttgaacattgctttaagcaatcatttgtgtatttgtattaattttcaatctaatcattccaaatgaggcaaagttttgtgtaccagtgattgaattagaagaaagaacaagttattttgtatagtctaaaagctttgtaagaatcctctgcttgcagtgtttgcacagttctccattagccctgtcgtgttttcttcttctttgagacatccattagtagatactttaacactaatccgttttctgtcccaaatacataggagtccaggagccagggatgcaggtgtcattttaccttctagtagtctatttttgtgttctggtgcatgtccgactgagctctatttttaaaagtacggagctgcttgctacctgaagccagagagatactgaagaatgaaagacctcgagagtcctgctgtctaaaggagtagcacagccagacactgatgagggtggag

SEQ ID NO: 368419 - DNA, 462 bp, Homo sapiens
gactgttcagatacagctccatcagggaaaccaaatatgttgctgccaccctgacatttttgtgtttttctacctgatcatctgtataggacaagggaatttcttctctgtggtgacctgtcatgaattaatgatcccagcatacccagtaaagtttttaatgtgcagtatgggttaattcataagacatggtctgactcaggtttgtttatacaaaaatgtgctctgtccacaccaacatggcacatgtatacacgtgtaacaaacctgcacgttgtacacatgtaccctagaacttaaagtatatatatataaaaaaacaaaactagttattgggcactatactctctacctggggttgcaccccaactctcagcatcacacaatatacccatgtaacaacctgcacatgtaccctctgaatataaaataaaagttgaaattatttaaaaaaagttctct

SEQ ID NO: 368420 - DNA, 9167 bp, Homo sapiens
tatgtttagtcccatatgctcttcctgaatcttgccactgcccatcaagagatagaatacatttcccctcccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctcccctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccgcctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggggatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttaaaaaaaaaag

SEQ ID NO: 368421 - DNA, 8466 bp, Homo sapiens
tgatctacaggatctctttgcggtgcctttccctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctcccctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccgcctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggggatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttaaaaaaaaaag

SEQ ID NO: 368422 - DNA, 466 bp, Homo sapiens
aattgggagtctcaatgacatcggtggatgatacagaaactgaggaagcaggtgtgtatgtcataaatgagttgacagacctcttcattatgcacagtggagctctgtggctgaggtagtaaaataagtttagatatttttaaaaagtgatcacttttcattttattaaatactaaatatagaaaataaaactgacacattgaattgcttgaaatctactgagaagaaatgcatttcagttttgactccgagggcaaaaaaggccttactttgaaaatacttatatttagagccttctatgaagggaatagaattgcacttgctttgtgatagcaaattagattttatgaggctttttggggaatttgaaaagcattttaatgtattattattcaagttaagaagaaacccagtaggaaaacaaataaactagcaaacaaacatcattaaggttggccagacctcc

SEQ ID NO: 368423 - DNA, 636 bp, Homo sapiens
ttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcaggtaacaaatactgttttaggaagaactttgtattgtggatttgattgctgagcagactacatagtgaaggatataaggcc

SEQ ID NO: 368424 - DNA, 9180 bp, Homo sapiens
gacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctcccctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccgcctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggggatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttaaaaaaaaaag

SEQ ID NO: 368425 - DNA, 5641 bp, Homo sapiens
gacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatctaatttatctcactgagggcctttgagaaaaacgcttcaaggccaggctcagtggctcagccaatataatcccagtactgtgagaaggggatctctagac

SEQ ID NO: 368426 - DNA, 466 bp, Homo sapiens
  misc_feature (20)..(20): n is a, c, g, or t
  misc_feature (35)..(35): n is a, c, g, or t
  misc_feature (97)..(97): n is a, c, g, or t
  misc_feature (106)..(106): n is a, c, g, or t
  misc_feature (108)..(108): n is a, c, g, or t
  misc_feature (112)..(112): n is a, c, g, or t
  misc_feature (131)..(131): n is a, c, g, or t
  misc_feature (135)..(135): n is a, c, g, or t
  misc_feature (139)..(139): n is a, c, g, or t
ggtcaagtatgaacacaagntcaccctcccagagnccccagcaggaggaagagaaaccaaagacttctgaaacgactcccccaaaaaaaaggggaanaaacccacngncaanaagggcccgctgttgtgtnaaanaaancccccacaaaaaagaagtcaatagaacgcatgcctgctttgccctccaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagcctaaaaaaaaaaa

SEQ ID NO: 368427 - DNA, 395 bp, Homo sapiens
atgagctataagccagccttgtttgggttcctattccttctgctgttgcttagcaactggttggtcaagtatgaacacaagctcaccctcccagagccccagcaggtgagcacaagatggggcttggcttcagctcagggataggggatatttgcagctagattaggtgggtagggaacagggtaggtgtcgaaataatggggcaagactggggaatccaagactggtctaaaccaccactctacagcttcctcttaggtggtgctgggtaaatcacttccctccacgaggcctcagttgcctcacctcagctgttaaatcaggaccaccccagactctcctatttcatgtttgatgtcaacatgctttggcaagagtaacaactactttaatgt

SEQ ID NO: 368428 - DNA, 519 bp, Homo sapiens
ctccgcaggcaccataggagcagtggcagcttggctgatgagctataagccagccttgtttgggttcctattccttctgctgttgcttagcaactggttggtcaagtatgaacacaagctcaccctcccagagccccagcaggaggaagagaaaccaaagacttctgaaaacgactccaagaacagcaaggccgtgaacacaaaagaagtcaatagaacgcatgcctgctttgccctccaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagcctaaaaaaaaaaa

SEQ ID NO: 368429 - DNA, 1883 bp, Homo sapiens
ggcgcagcggggcggacggcggcggcgccgcgggggcgggcgccggtaggggccggacagggtagggcccggagggcggtggcggcggagcgggcggcatgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttac

SEQ ID NO: 368430 - DNA, 2251 bp, Homo sapiens
  misc_feature (1478)..(1478): n is a, c, g, or t
  misc_feature (1525)..(1525): n is a, c, g, or t
ggcgcagcggggcggacggcggcggcgccgcgggggcgggcgccggtaggggccggacagggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacntaaccaatcatttaaaaatcgctattgtgtagccactggccaccacnctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctg

SEQ ID NO: 368431 - DNA, 1216 bp, Homo sapiens
ggcgcagcggggcggacggcggcggcgccgcgggggcgggcgccggtaggggccggacagggtagggcccggagggcggtggcggcggagcgggcggcatgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatgtaagtttctttgtaaatgctattttcactttaagatggtgtcagcacgtggtatgaatctattatgtgttaatatttagttaactttatagtactgtgctgttattcttgtgagaagctgatcctgggacttttatgaaccactctttctgatttggagattgactggagactagcttctggtttaagggactattctttctttccgtagagcagtcagaactgaagacaacatgggtggatgtggagttcgaacctggggatcgggtaaagataccaggtacggtgtaagtgtgtgccctctgagaacctgcaattaagtggaaatctctggatctttgcttttcttgaaaatgatgtctaatagg

SEQ ID NO: 368432 - DNA, 1839 bp, Homo sapiens
  misc_feature (1066)..(1066): n is a, c, g, or t
  misc_feature (1113)..(1113): n is a, c, g, or t
gttggggcatttggacggtgttgtagcatcatggacatcttgcctagagaccgttctgtagccctggcttccagggtctgctgtgaaggcactcccgggatcagagagaaactcactgtcacccgcattagacaagatccccaggcttgggattgaactggagcacctgacgttttgcttactgtggcctgattgtgtgccttgggctcaggtgatgctgtcagagtggacagaatcctccctaagatctcaagccctttgtgaggggaccttcctcaacccctccccggctcacctgcctcacaccgtcctcagccaaggctgcctgattctagctctcaacacagcacgctccttacccctggcctctgcctgctggcctccattcatccttccagcctcacttcctcacaggtttctttgatcacatctcctagaccgatcaaggtctcggagcaaaggagtttcttttcattgaagcctgatctccgtgtgcggctgtattctcactggtgtggctatcggtcagcggctgcttttgctcattaccggtttacgcagtgccacgcagtgcctggcatgtagtaggtgcttcctaatgtggtatggacacttattcattggaaatcagccccgaggccccatggcacagaccccttctctgtggctggtcttggcaatgctcctctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacntaaccaatcatttaaaaatcgctattgtgtagccactggccaccacnctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctg

SEQ ID NO: 368433 - DNA, 527 bp, Homo sapiens
ttagacctttaatttaccagtttttattatatccactccttcctagaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatgtaagtttctttgtaaatgctattttcactttaagatggtgtcagcacgtggtatgaatctattatgtgttaatatttagttaactttatagtactgtgctgttattcttgtgagaagctgatcctgggacttttatgaaccactctttctgatttggagattgactggagactagcttctggtttaagggactattctttctttccgtagagcagtcagaactgaagacaacatgggtggatgtggagttcgaacctggggatcgggtaaagataccaggtacggtgtaagtgtgtgccctctgagaacctgcaatta

SEQ ID NO: 368434 - DNA, 2713 bp, Homo sapiens
  misc_feature (1940)..(1940): n is a, c, g, or t
  misc_feature (1987)..(1987): n is a, c, g, or t
ggcgcagcggggcggacggcggcggcgccgcgggggcgggcgccggtaggggccggacagggtagggcccggagggcggtggcggcggagcgggcggcatgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacntaaccaatcatttaaaaatcgctattgtgtagccactggccaccacnctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctg

SEQ ID NO: 368435 - DNA, 2259 bp, Homo sapiens
  misc_feature (1486)..(1486): n is a, c, g, or t
  misc_feature (1533)..(1533): n is a, c, g, or t
tgcaacgatggaggcacccacagtggtggaggagtcccagtgcaccccggaagaggagtctccagccaagccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacntaaccaatcatttaaaaatcgctattgtgtagccactggccaccacnctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctg

SEQ ID NO: 368436 - DNA, 3487 bp, Homo sapiens
cagctaagacccggagaggtggaatttcactttgaaattcccttgcctcgtgagggccggcgctgggcatgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactctta

SEQ ID NO: 368437 - DNA, 788 bp, Homo sapiens
cacatcgtgagtcattttactttaaaagggaaaaacagtggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactctta

SEQ ID NO: 368438 - DNA, 2473 bp, Homo sapiens
agaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactctta

SEQ ID NO: 368439 - DNA, 2696 bp, Homo sapiens
agaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactctta

SEQ ID NO: 368440 - DNA, 2756 bp, Homo sapiens
agaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactctta

SEQ ID NO: 368441 - DNA, 1510 bp, Homo sapiens
accgaggcggtagtgcgcgcagctcaggggcgggtattgccgcggcgttgcagtcccctcaaaacgcttcgttcatcatccctttctaacttctccctcggccttccttttgagctatggtctttttcccagacaggaagagaagagttgcccctacctccggagccgagggagaatgccgcaatagcgatggcggccctcggcgcagtggggcggcctcaacctaacccggggcggggcctcgggggcggggtctcggcggggcggtcgctttggagccgcaaagtttggctgtggcggcaaatgggcttgggcggctcctcggcgggtggcggtggtggccgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatgtgagtgactaaccgcgggagcagggccagaccggctccagtcgtgcgcctctcccttgtttctgtcggtgtctctcatcaccgtatctgcagccaaggcttctcagggtggggctccgcaggcactggggctgagatccctcgccaccagccccagcgaggctgctctagggacaacggctccgctctctggggtgactcgccttcttccctctccgcctccgcagggacagttccattcaacaggtagcccttctttcctggggcgcaggcacccagaggctatctgcttagttcctttccaccgtctcgcgggtcccccacttggcagtcagtttcctttcctcctcctctcccaggttgcttttcctcgatttccttttgaaattctctgaggaatacttgtgtgttctccgcccacgttccaaggatgagtggccttgctctgtgtgtgtcttccttcttccatgcgtaggaaaggagggaactgtttgcgattgaggggatgggggggagcccaggaagcaacgagggccagggatacctcttctgccaaaagaagggtctcctctcgcgctccttctccacccctctttctggtgagccgtgttttcagaattccacctcgatttcgtttcggtttctgggactgttatttggtaggctgtgagtcccacccaccccctcgctcggttgccttgggtggagtccgcgcaggatgtgaaccgaagagagcaaaatgtgaattaatggaccacgcacaggagctccacgccctccttggatccctcctccttttcctgtatataatgtatagccgcagggtacaagtgagtaccagtttccttgagcaacctaagaccaatttcttgccctttctggtttccacagaaaacttcagggttgtcttaaaaaataaaagacaagatttatatacacataaaa

SEQ ID NO: 368442 - DNA, 3262 bp, Homo sapiens
accgaggcggtagtgcgcgcagctcaggggcgggtattgccgcggcgttgcagtcccctcaaaacgcttcgttcatcatccctttctaacttctccctcggccttccttttgagctatggtctttttcccagacaggaagagaagagttgcccctacctccggagccgagggagaatgccgcaatagcgatggcggccctcggcgcagtggggcggcctcaacctaacccggggcggggcctcgggggcggggtctcggcggggcggtcgctttggagccgcaaagtttggctgtggcggcaaatgggcttgggcggctcctcggcgggtggcggtggtggccgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368443 - DNA, 2975 bp, Homo sapiens
agcgggttcacctgcgtcgttccgggagcctcgtcgacggacggagcgccgcgcgcgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368444 - DNA, 2245 bp, Homo sapiens
aaagatggccactgactttaaaagaaagaaattgcaattattgaccaagaaaccactttatcttcatctacatcaaactttgcacaaggaatgatcctgacatgatgaacctggaacttctgtgaattttaccactcagtggccgtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368445 - DNA, 1867 bp, Homo sapiens
gcacgagctcgtgccgattcggcacgaggaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368446 - DNA, 1203 bp, Homo sapiens
gtaccccacaccacctgagtccatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368447 - DNA, 369 bp, Homo sapiens
gctgaagtttgtcccagtgaaatggtatgaaaagtattgtatcttattttcatcatcattgtataaagagtttttttttttttgagaagaatttggttctcaatgtagatttgtattttaaaaacaggacaataattgtacttcacatgttaaaaagctttaaattgttacactttgttgcagtagtttgcttttcttccattctaaagaatatgttttcttcttacagattagcaagacatctacaaaaggaggcccaagctcaacacaataattctgaattcacagaagaacaaaaggtaccataaaataatctctagatatatcagattccaaacaaaaagtgttttgtcttttgagttcattaag

SEQ ID NO: 368448 - DNA, 280 bp, Homo sapiens
aagatataatttttgattttgcttcatggaagaattcttatcttcttattctagtcctaaagaatattcttacatataataaagaattcccatttgatgttcagcctgtcccattaaggtaaaagaaacatttatatttgttttcttattttattttatacctctctttcagatagttctgggttttcttaaatatcaactttggtattattgatatcattgacatcaacaatgataacagtatatcagcattttattttatttcagtattattattttt

SEQ ID NO: 368449 - DNA, 1739 bp, Homo sapiens
accgaggcggtagtgcgcgcagctcaggggcgggtattgccgcggcgttgcagtcccctcaaaacgcttcgttcatcatccctttctaacttctccctcggccttccttttgagctatggtctttttcccagacaggaagagaagagttgcccctacctccggagccgagggagaatgccgcaatagcgatggcggccctcggcgcagtggggcggcctcaacctaacccggggcggggcctcgggggcggggtctcggcggggcggtcgctttggagccgcaaagtttggctgtggcggcaaatgggcttgggcggctcctcggcgggtggcggtggtggccgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtg

SEQ ID NO: 368450 - DNA, 3208 bp, Homo sapiens
accgaggcggtagtgcgcgcagctcaggggcgggtattgccgcggcgttgcagtcccctcaaaacgcttcgttcatcatccctttctaacttctccctcggccttccttttgagctatggtctttttcccagacaggaagagaagagttgcccctacctccggagccgagggagaatgccgcaatagcgatggcggccctcggcgcagtggggcggcctcaacctaacccggggcggggcctcgggggcggggtctcggcggggcggtcgctttggagccgcaaagtttggctgtggcggcaaatgggcttgggcggctcctcggcgggtggcggtggtggccgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaatgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368451 - DNA, 2890 bp, Homo sapiens
gaacgaaccccagtttagcttgtattataagctctccaatgaccaatggagatgcggggcaaggggattcagcggatctagctgttaatgccactgatttgtggtgaccaatatggattttctttctgtcgtttgtttcaaggcactagaaggagacttttggtccactgtccaggggtctatggagactaatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaaa

SEQ ID NO: 368452 - DNA, 1713 bp, Homo sapiens
actgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttaaaaaactagaataaacagagaggcataaacatatcttagagtccaagtggtagtgtttagcattggatataataaatggatgttttacaaagtgtttccataattc

SEQ ID NO: 368453 - DNA, 1642 bp, Homo sapiens
actgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttaaaaaactagcatcccccccccggcctccccctcac

SEQ ID NO: 368454 - DNA, 921 bp, Homo sapiens
gacgctcaagagagcaagatgttctcgtgttgcttctccactttgagaggttgctgcttcaggaacggagggagtgagagccttttctgacgatgccgaagaaggctcatccctcaccccagacgcctgtcgcccgttgtaataaggcgcatccaggtaccacaggacagcctggggcaggccctagcaggccaggccacaccagagatcccattggggctgcagctgcacactgtccttgtccaggagattcaggagctcattgaggcacagacacgtggtgaggtggcctgcagcctggaagactttgcaggggcggtgcttttgggctggaattcccttaaattcagtgaggtcgtttctgtgtttggaaattccagtggaaagtgactgatgctggtgaccctttctcctttctcagctcctggtccatgtgcagaagtaagagcactgccagcaccagcggcggagccagagccagcatgggaagaggcccctccagagagagcactggagctggagggagctccagccaaggaccagaccaatgaggagctgcctgaaatcacggaggtgccggagagcattaaaagaaggctgggaggaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttcatgcctttttgaa

SEQ ID NO: 368455 - DNA, 780 bp, Homo sapiens
gacgctcaagagagcaagatgttctcgtgttgcttctccactttgagaggttgctgcttcaggaacggagggagtgagagccttttctgacgatgccgaagaaggctcatccctcaccccagacgcctgtcgcccgttgtaataaggcgcatccaggtaccacaggacagcctggggcaggccctagcaggccaggccacaccagagatcccattggggctgcagctgcacactgtccttgtccaggagattcaggagctcattgaggcacagacacgtgctcctggtccatgtgcagaagtaagagcactgccagcaccagcggcggagccagagccagcatgggaagaggcccctccagagagagcactggagctggagggagctccagccaaggaccagaccaatgaggagctgcctgaaatcacggaggtgccggagagcattaaaagaaggctgggaggaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttcatgcctttttgaa

SEQ ID NO: 368456 - DNA, 4079 bp, Homo sapiens
ataatacctaccttgcaggaccacgacaggattaagtgaggaaaaacccccatgagagtgttttgccattgtcaagtgagcctgagggaggctgaggggggatcaggctgtatcatgcccccgaggacaaactttccagtttaccctgctccctctctctgtccctaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368457 - DNA, 4168 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368458 - DNA, 4722 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368459 - DNA, 4576 bp, Homo sapiens
ataatacctaccttgcaggaccacgacaggattaagtgaggaaaaacccccatgagagtgttttgccattgtcaagtgagcctgagggaggctgaggggggatcaggctgtatcatgcccccgaggacaaactttccagtttaccctgctccctctctctgtccctaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaagtgcctctgaaagggccccccagaagtgagcagtgcgccgtcaagcgggtgtgcagggcacacagctgcacggcacagtgtgggtctgagtcactgccggaggagggaccagggtggtctgggccgcagcccctttaacaatctgcccttcctgccctgcaggaagaacccattctgaacacaccctggctgtccctggctgccccactttggggtgacaaagaggaggcagccctgggctgagtccacagagaccagccctgatatggcaggagtgggggtggggtgggggagtgggaatacaggagctcagccccagctcaccacggcatccccgaagagttgtgactcagacacacctgggtttaagtcccagctgggagctcaggtaagtcaaatcgtcttctggggcctctgtttatcagtagaaggctccagaagtatacactgttgatggctccttcccgctctgatgcaccatgcctgattaagca

SEQ ID NO: 368460 - DNA, 6590 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatctatactagggataaaaatgagtaaaatagattcccatatcaagggctgggtaggggagccgtgatgtctttacataatggtaaagacatggctgattcctcttacggtgggtgccctcacactgagccagattccaggacatggttcctcacagcagcaggcaggaggagcattctcctggcctgggcacccatgcagagcggccgtggtgatggtcagttctcccatgttgtgttcgtcccacctcccaggccctcctttcctgagtgctgggctgagcactggtgggggctgtgtttaagtgggaggcccgagcttggggctctgggaggtcactgtgacacagaccctgtctgcaggcaagcaggctctcctgatgctctcaggagccccgcacctgtggggaatgagtcaaaggtggccttgcagccacaggggatgagagaaaggctgggcacctgctaggactccctcacagccatgttgaacccactctgcgtaccctgtcaggctgtgcgggagtgggagcgaagtgaggagaggggcaggtgggagagccgaccccaagtggaggacaggcccgctcctccggggccctgggcctgagacaccaacctcaatatccggtctaggacgcagtgtggaggggcttgctttctccaaccctttctgacctggcatcttaccccaggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368461 - DNA, 3275 bp, Homo sapiens
aagaagagagggtgtagctcagtgaaaaagacacaggctagagtcaatgacccaagttcaggtcctaccttgctgccacttactagctgtggggcctttcccaaggcccttaacctccctgagccttgagtgaagcatactagtaggttttgtacgacattcaatgtgaaagcactttggaaatagtgattgatacatgtgagtcattctttattagggaggaagcaagcagggaagccacaggggtagagaacagggtcacctctccactcccgcccctcccatttctcccctcccaacctctaggttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtaagcccggctctcaggactacccaaggagcaggcagatgggatgggacagggtgggagtggccaagcctgaaacaaggtaggcgaagcgaaagcctctgttccaagttaggtccaggcagcatctcctggcctaggtagagtgtgcttgtggctagaaggctggggcccctggggtgggagtgagctgggcctgtgggtccctgagagactggtggctgatgtactgttttctataggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatctatactagggataaaaatgagtaaaatagattcccatatcaagggctgggtaggggagccgtgatgtctttacataatggtaaagacatggctgattcctcttacggtgggtgccctcacactgagccagattccaggacatggttcctcacagcagcaggcaggaggagcattctcctggcctgggcacccatgcagagcggccgtggtgatggtcagttctcccatgttgtgttcgtcccacctcccaggccctcctttcctgagtgctgggctgagcactggtgggggctgtgtttaagtgggaggcccgagcttggggctctgggaggtcactgtgacacagaccctgtctgcaggcaagcaggctctcctgatgctctcaggagccccgcacctgtggggaatgagtcaaaggtggccttgcagccacaggggatgagagaaaggctgggcacctgctaggactccctcacagccatgttgaacccactctgcgtaccctgtcaggctgtgcgggagtgggagcgaagtgaggagaggggcaggtgggagagccgaccccaagtggaggacaggcccgctcctccggggccctgggcctgagacaccaacctcaatatccggtctaggacgcagtgtggaggggcttgctttctccaaccctttctgacctggcatcttaccccaggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368462 - DNA, 5462 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368463 - DNA, 5575 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368464 - DNA, 6782 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatctatactagggataaaaatgagtaaaatagattcccatatcaagggctgggtaggggagccgtgatgtctttacataatggtaaagacatggctgattcctcttacggtgggtgccctcacactgagccagattccaggacatggttcctcacagcagcaggcaggaggagcattctcctggcctgggcacccatgcagagcggccgtggtgatggtcagttctcccatgttgtgttcgtcccacctcccaggccctcctttcctgagtgctgggctgagcactggtgggggctgtgtttaagtgggaggcccgagcttggggctctgggaggtcactgtgacacagaccctgtctgcaggcaagcaggctctcctgatgctctcaggagccccgcacctgtggggaatgagtcaaaggtggccttgcagccacaggggatgagagaaaggctgggcacctgctaggactccctcacagccatgttgaacccactctgcgtaccctgtcaggctgtgcgggagtgggagcgaagtgaggagaggggcaggtgggagagccgaccccaagtggaggacaggcccgctcctccggggccctgggcctgagacaccaacctcaatatccggtctaggacgcagtgtggaggggcttgctttctccaaccctttctgacctggcatcttaccccaggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggtaatgccagacccctggccctgggcccacagcctctccaccgcttcattcctccctgcttgaagaccccgggtccgctatgcagccaccccaaccctcccaggcttcctgaccagggttgagaggaagcttagctaaggcccttgctgcaggcctggtgctccagcatcccacccttgtccctccccacaggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368465 - DNA, 4099 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggtagtgatgataagaataatagcagataacatcagtacaccactaatcacatccagacactgatggttttacacatgatggatttaatcctgactataacccactttacagatgacagacgtgcaccatggcaactggacccagcagacttctacaagacccagtgggcgttactttccctggattgcctggagaccgggattttccggggaagtggggcgtggatagagagcgtgatgcccatgcgcgggagatctccgagactgaacgggggttgcggggaatgggacgggctgaggtacccggggccccgcggggggcgtccagcttttgttcccgcgttgtggttccttggcggccggtgtatagtgtgcgagtgcgggagtgttgcatcgggggggggacacacacccggtggagtagcgggtgggtctgttctggggggcacctcgtatgagggagcgccaccacctgtagtggttccatgactgtggggagcactcgcgcggagggtgtacgacacaccggtgcgtgc

SEQ ID NO: 368466 - DNA, 2735 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggtagtgatgataagaataatagcagataacatcagtacaccactaatcacatccagacactgatggttttacacatgatggatttaatcctgactataacccactttacagatgacagacgtgcaccatggcaactggacccagcagacttctacaagacccagtgggcgttactttccctggattgcctggagaccgggattttccggggaagtggggcgtggatagagagcgtgatgcccatgcgcgggagatctccgagactgaacgggggttgcggggaatgggacgggctgaggtacccggggccccgcggggggcgtccagcttttgttcccgcgttgtggttccttggcggccggtgtatagtgtgcgagtgcgggagtgttgcatcgggggggggacacacacccggtggagtagcgggtgggtctgttctggggggcacctcgtatgagggagcgccaccacctgtagtggttccatgactgtggggagcactcgcgcggagggtgtacgacacaccggtgcgtgc

SEQ ID NO: 368467 - DNA, 1834 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagctagcggaggtgattctgaaaaaacagcaggcggccctagaaagaacagtccatcccaacagccccggcattccctacaga

SEQ ID NO: 368468 - DNA, 4190 bp, Homo sapiens
ataatacctaccttgcaggaccacgacaggattaagtgaggaaaaacccccatgagagtgttttgccattgtcaagtgagcctgagggaggctgaggggggatcaggctgtatcatgcccccgaggacaaactttccagtttaccctgctccctctctctgtccctaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368469 - DNA, 5421 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368470 - DNA, 2140 bp, Homo sapiens
atgatgcgggccctgactctggctcccgcaggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368471 - DNA, 6870 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtaagcccggctctcaggactacccaaggagcaggcagatgggatgggacagggtgggagtggccaagcctgaaacaaggtaggcgaagcgaaagcctctgttccaagttaggtccaggcagcatctcctggcctaggtagagtgtgcttgtggctagaaggctggggcccctggggtgggagtgagctgggcctgtgggtccctgagagactggtggctgatgtactgttttctataggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatctatactagggataaaaatgagtaaaatagattcccatatcaagggctgggtaggggagccgtgatgtctttacataatggtaaagacatggctgattcctcttacggtgggtgccctcacactgagccagattccaggacatggttcctcacagcagcaggcaggaggagcattctcctggcctgggcacccatgcagagcggccgtggtgatggtcagttctcccatgttgtgttcgtcccacctcccaggccctcctttcctgagtgctgggctgagcactggtgggggctgtgtttaagtgggaggcccgagcttggggctctgggaggtcactgtgacacagaccctgtctgcaggcaagcaggctctcctgatgctctcaggagccccgcacctgtggggaatgagtcaaaggtggccttgcagccacaggggatgagagaaaggctgggcacctgctaggactccctcacagccatgttgaacccactctgcgtaccctgtcaggctgtgcgggagtgggagcgaagtgaggagaggggcaggtgggagagccgaccccaagtggaggacaggcccgctcctccggggccctgggcctgagacaccaacctcaatatccggtctaggacgcagtgtggaggggcttgctttctccaaccctttctgacctggcatcttaccccaggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368472 - DNA, 1631 bp, Homo sapiens
  misc_feature (25)..(26): n is a, c, g, or t
aataatgctagtacgaggcgggtgnngtcagactagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368473 - DNA, 3739 bp, Homo sapiens
  misc_feature (3612)..(3613): n is a, c, g, or t
  misc_feature (3672)..(3672): n is a, c, g, or t
  misc_feature (3701)..(3701): n is a, c, g, or t
ataatacctaccttgcaggaccacgacaggattaagtgaggaaaaacccccatgagagtgttttgccattgtcaagtgagcctgagggaggctgaggggggatcaggctgtatcatgcccccgaggacaaactttccagtttaccctgctccctctctctgtccctaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgaanncttgggaccccattgcacagatgtatagtgcagtggttagaaaccagaatctaggactnactaacctgggtgtgaattctggcttcancacttaaggttttgacctcggacaaagttaatttaact

SEQ ID NO: 368474 - DNA, 4282 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaacccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcagccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggactgcacagaggaggactggctccggctccgtcgggctcacccttaaccactattcctggctctgcaaaccccagactttgcacacagccccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttta

SEQ ID NO: 368475 - DNA, 1248 bp, Homo sapiens
aagttcagtttccccatcagtaaaatggggagaaaattccaagcacacttctcagagcagagcagaagaggttgactatggagaggagaatgaagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactggtgagtctgctgcttcttcagggaaggggctgggtccctgcaccctgctaagagccaagcttgggatggacccatccttcctccccatctctgtccccctgtcctgcgcattgccctgctgcaccctggccccccaccctataccctcgcttccttccattgctccctgtggttcccacctatcacaccccatcca

SEQ ID NO: 368476 - DNA, 403 bp, Homo sapiens
tgagtcggaactctttcagcagaaaactgtatctctgtggcgttgaatatgaggataggttccaggagcaccagtagacggaatgtttgccctgtcacaagcatttctcctggcctagagactggcaggggttcctgcatccctaagcagggacccctgcaccaggcgaaggacgagcccccttccagcaacgcgggatgagccagggcctctcccctaccctgcttgtccttcctctgcccagtaccctgcgtggctgctcaggagagtgacgtgtggaagccactcggggtgagcagagggtctcttagtgatgctgtttgtttcctgggacgtgggtcagggagcccctaccctggttgagaaccactgaggtaggccgggattttggattccatcccca

SEQ ID NO: 368477 - DNA, 2448 bp, Homo sapiens
ctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgaggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368478 - DNA, 782 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataagatggaatgcagtgatgcgatctcagctcagtgcaccctctgcctcctgggtcccagagattctcctgcctccgcttcccgagtagctgggattacaggcatgcgccaccacgcccagctaattttttgtatttttagtagagacaggatttcaccgtgttggccaggctcatctccaactgacctcatgatcc

SEQ ID NO: 368479 - DNA, 2523 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368480 - DNA, 2878 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaaga

SEQ ID NO: 368481 - DNA, 1992 bp, Homo sapiens
atcccgcacgggtgatgcggttggtgaggagcagcatgaaataagcatatttttgagacccacaggtcttgggcagggctcagcgcaccactggtcgcatggtaagggtcgctctttcccttaacccgatccttaagcccttgaagaaaacatagaagagttcaatgatattcaagggcagggacaccaaggacaccaccagcatgaagatgatgaagaagattaccccaaattgggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368482 - DNA, 1466 bp, Homo sapiens
ggacccttacgcgactgggactggctggtacgaggcctcccacactgtcactgtcacctccaccagcactgaccacaatgactagatcagaatgtaaaagagggaaggtggtacgtaaaggagcgcgaaagaagaggtggggaatagagggaatgagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368483 - DNA, 2491 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataaccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368484 - DNA, 2219 bp, Homo sapiens
gagatgtaaacagaaacttgcttaaagaggagtacggtttaataacgcttgaagaaaaataatgcaaactaactttagtcattataaatcttacagtcattcttcattccaagtttaatataataattgatatatttggtaaatatgtatgaagtaaaggctcagaacttggggaattttcaggctggaattcattgtaccatataaaggttcctggacgggcgcagtggctcacgcctgtaatcccagcactttggaaggctgaggcaggaggatcacctgaggtcaagagttcaagaccagcctggccaacgtggtgaaaccctgtctctactaaaaatacaaaaattagctgggcatgatggtgggcgcctgtaatcccagctacttgggaggctgagaaggtaaaaaaaaaaaaggaaatctttaaacagtgtaaaccaaaactatctgagacagatctcaatcaatttagaagtttattttgccaaagttaaggacctgcctgtaagaaaaaaacagaatcacagaaacagtctgtggtctgtgcctttctccaaggatgaatttgagggcttaaaagttttaaaaagaaaaagggctggacggagtggctcacggcagtaatcccaacactttgggaggccaatataagagaatcagttgagcccaggacctcgagaccagcctgggcaacatagcaaaaccccctttctacaaaaaaatacaaaaaattagccaggcgtggtggtacatgcctgcagtcccagctacttgggaagctgaggtgggaggatcccctgagcccaggaggtcaagggtgcagtgagccgtgatcgcattgttgcgctgcagcctggacaacagagtcagagcctgtctcaaaaaaaataaaaagtaaaataaaggggaaatgcgggctggaggggaaagtaggagggtatggtcatccacatgttgcaagagaaaaggagcagataggggaaagtcaattatgtattcatctcatgcccggtaaatcggcacttcacataaggtaaggtgaacataaagtagctgcctgtggggatatttaacgttttatctgtaggtgtctgcttagcaacaaaaggaaaggcagtttcttgcatgactcagctttcagcttaattttttccttttgacagagcaaattgggatcctgaatttttatttttctttgacaacagaaatcaacacagatctcttttagttacctaattcttgatggacatcaggatgttgaccacttttagtaatatttaatatatatcttatttgttccatttatcccccgagtattgtagccacatttaaagtgaaaatttcctgtgtcaaattaacttttccaatattttttgtccattttttccatgtctgcttgaattgaattcgctccaggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368485 - DNA, 2307 bp, Homo sapiens
gagatgtaaacagaaacttgcttaaagaggagtacggtttaataacgcttgaagaaaaataatgcaaactaactttagtcattataaatcttacagtcattcttcattccaagtttaatataataattgatatatttggtaaatatgtatgaagtaaaggctcagaacttggggaattttcaggctggaattcattgtaccatataaaggttcctggacgggcgcagtggctcacgcctgtaatcccagcactttggaaggctgaggcaggaggatcacctgaggtcaagagttcaagaccagcctggccaacgtggtgaaaccctgtctctactaaaaatacaaaaattagctgggcatgatggtgggcgcctgtaatcccagctacttgggaggctgagaaggtaaaaaaaaaaaaggaaatctttaaacagtgtaaaccaaaactatctgagacagatctcaatcaatttagaagtttattttgccaaagttaaggacctgcctgtaagaaaaaaacagaatcacagaaacagtctgtggtctgtgcctttctccaaggatgaatttgagggcttaaaagttttaaaaagaaaaagggctggacggagtggctcacggcagtaatcccaacactttgggaggccaatataagagaatcagttgagcccaggacctcgagaccagcctgggcaacatagcaaaaccccctttctacaaaaaaatacaaaaaattagccaggcgtggtggtacatgcctgcagtcccagctacttgggaagctgaggtgggaggatcccctgagcccaggaggtcaagggtgcagtgagccgtgatcgcattgttgcgctgcagcctggacaacagagtcagagcctgtctcaaaaaaaataaaaagtaaaataaaggggaaatgcgggctggaggggaaagtaggagggtatggtcatccacatgttgcaagagaaaaggagcagataggggaaagtcaattatgtattcatctcatgcccggtaaatcggcacttcacataaggtaaggtgaacataaagtagctgcctgtggggatatttaacgttttatctgtaggtgtctgcttagcaacaaaaggaaaggcagtttcttgcatgactcagctttcagcttaattttttccttttgacagagcaaattgggatcctgaatttttatttttctttgacaacagaaatcaacacagatctcttttagttacctaattcttgatggacatcaggatgttgaccacttttagtaatatttaatatatatcttatttgttccatttatcccccgagtattgtagccacatttaaagtgaaaatttcctgtgtcaaattaacttttccaatattttttgtccattttttccatgtctgcttgaattgaattcgctccaggtttccattaactttggaccatgcttcaagtatcctccgaaggatctcacttaccgccctgtgagtaacattacaaatggctgcatgtgtcctcagcatctccgtggctgctgtagtcaccgtgttctgtttctcattcctcctgcagatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368486 - DNA, 2233 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccagagaaagcttggactatatttctggaaggcacccactgtggggtgctgcttgttctgtggtgttgctgtgcagcggccgggaggagcagagggctgcaggagaccctctgagattctgctttgtgcacatgtactgccagcgcatggcattcttgagcccataaagcaagacttctcaggccctgtggttagcatcccccacacccatatcagccactagcattttaaagatggttttaggtgggtacataagggcccagaaaaaaagttttacaattattttaggggcctgaaccctcatgtcatagctaatcagtgaatgaagttaccttttaatcc

SEQ ID NO: 368487 - DNA, 1589 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcccttatgagctcggataagccaaaggagaaggggaaaataaccagtcattaagaaggaaggcaaggccgcagaggctgtcgctgcagctgtcggcactggagccaccacagcagctgtcatggcggcagctggaatagcagccattggcccttggcccttatcgag

SEQ ID NO: 368488 - DNA, 259 bp, Homo sapiens
ccaagatcatgccactgcactccagcctggtgacagagcaagactccgtctcaaaaaagaaagaaaaagttaatgcatgaagatttccatgtacttttagtctgtcagtaggcaccattgaagcaggtaaaaaaaaaaaaggaaatctttaaacagtgtaaaccaaaactatctgagacagatctcaatcaatttagaagtttattttgccaaagttaaggacctgcctgtaagaaaaaaacagaatcacagaaacagt

SEQ ID NO: 368489 - DNA, 2547 bp, Homo sapiens
ctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368490 - DNA, 2360 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgct

SEQ ID NO: 368491 - DNA, 2705 bp, Homo sapiens
  misc_feature (2537)..(2537): n is a, c, g, or t
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttaaaaaaacaacaaanaaaaaacttggggccgctctgcccctgaaaaaacttctctgaaacccctgcgttggggcgcgggccccgttgggtatctgacactggcccaactgttccaggaacaccgtgccgaactagggtgtgattcccacattaaaaaacccggcggaccgatgttgaaaatcg

SEQ ID NO: 368492 - DNA, 2005 bp, Homo sapiens
gaaaaggacgaggagccaagcgcaaacagcaggatggagggaccacagggaccacgcgagaaggcccggaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368493 - DNA, 1982 bp, Homo sapiens
tgattatttcttagaaggaaaaacgatactatcttttttggacactgcacctaggaattgacttttagagttagtggttgattattaattccatacttttaagtataaaatgttcattaatagtaaaacactacttctttttagagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 368494 - DNA, 2252 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaatatcgtgagcgctgacataacgtgtgatcgcatatcacg

SEQ ID NO: 368495 - DNA, 1778 bp, Homo sapiens
cgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacgtttccattaactttggaccttgaacttacgtatcatgtggagaagatccaattac

SEQ ID NO: 368496 - DNA, 627 bp, Homo sapiens
atcattttctgaattagtttggttttgttgttaagagtctgccacagattggaaggttaaacaggtatggagagtgaaaagcggtagttgttaagatttcagaaggagaggagtagtaaattttgccttaaaattttgttggaaagaatgtttaggagtcattactgatacgttagccagcagcaacaagaccaagaagaaagaaatttaatgtctgtttgtaacatgtgtcaggctttcagtttgaacttcagcaaagtagtgcttacttcagcagcatacctacaagaattggaacaatacagagaagattggtgtggaagaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcaggcatggtggcgggtgcctgtagtcccatctacttgggaggctgaggcacgagaatcgcttgacccaagagatggagattgcagtgatctaagatcgtgccactgcactccagcctgggcaaacagagcacgactccatctcca

SEQ ID NO: 368497 - DNA, 904 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccatccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368498 - DNA, 1170 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggccggggggtgaactcaacaacggaagccgatctggtaaacccgagggcctggcgggccggtaccggaggcgcaggggtggaacccatccagcgcaaggacggggcccgagccgattgaggcgcggcggggcccaactggggcaaggggccagggacccttcgctagcgcgtgggggggggccccaaagaatgggaaaaaaa

SEQ ID NO: 368499 - DNA, 542 bp, Homo sapiens
gcagccccggcgactggagaagccaccctgaaactggatctgcagctgggagacacggatgagctggggaaactccagcgtcacccactgggagggccctggtctgagttccaacatgtctcctcatcctggtcgaaaagatgtttttttccaaactgccgagtgttgcgattcagcactgaactcaccctgctcactgtctctggacaaaccaaagagtgggtcatgtcggttccacaagacctcgcagggcttaggattgggcacagccttggttcgaatcccggcgcctcctcaagctacagggcggcgcgatcttggctacgccttggcctgaacgtcctcacctgtaacttgggacgagaaccgccactccctcgcccaccccagtcctaaatgtcgcctcgatcaatcccctgccggaaaatttgggagagaggatcagggaaaccgccaatgcccggaggccaggcctttcacaggaaacagatttcccgcgggtttcgggggcggtggctttttgtgcgaggctgtttctctgc

SEQ ID NO: 368500 - DNA, 1268 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368501 - DNA, 1597 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatgagggactttgctgtgcttcccggagggcttcctggaggagacagcccctagaggtctcacaccttctccccaagcacccgcaggtggtagatgaccacacggccaaaaaagtcagtggcatcctcaaacgtcaccttcagccggtccacttcagcagctggtatggggaaagtgtgagcgtgggcagtcaagggaaactggtgatttctggtttcccacccgcaggcccccaccccttccagacccagctcacactccaccgatgtgggcaacctggggaagctgcaggtccctctaagcctctcacacagaacaggtggtcatcag

SEQ ID NO: 368502 - DNA, 1657 bp, Homo sapiens
  misc_feature (1657)..(1657): n is a, c, g, or t
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaaaaaaaaaaaaaaaaaaaaaaaaaaaaaaaaaaaaaaaaaaaaagggggggggggactaaaaaagtacccacgagggagccacgaagatagagcggaaccacaaagaaatgggagaaaagaggggcccaatatagaggacagaaaataaaagacgaggcaggggccacggataaacagagacagaatgggggaaaagatgtaagacgaggagaactctggcgagagaaacccatataagaggggagggggagaaaataggggagaaaatactatgaggaaattagagacgagagagatatataaaaaaatgaagggtaaaaggtgtgaaagaggagaaaaaagggaagaagagaaaagtggaagagggagagatgtagaaaatttacggn

SEQ ID NO: 368503 - DNA, 1338 bp, Homo sapiens
gcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368504 - DNA, 1343 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagatggagtttcgctcttgttgcccaggctggagtgctatggcgtgatctcggctcactgcaacttccgcctcccagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368505 - DNA, 1133 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368506 - DNA, 1677 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagcccctgtccatccaccagctcgcagcacagggggagctggaccagctgaaggagcatttgcggaaaggtgcgtgtccacacacatgtgctggcatgtctgcacctggctggtgtgtgcatatgggtgtccatacccactcatgacgtgacctgtgagtgtccacgtgtatgattgtatctaactgtgtgtgtgaccgtgttcatgtatgtccatcaacatacgctccccctcattcccctgtctaaccccagccccccacctcgtccccatttggcagcactggggatagggggcaggggtgcagcctggtggtattgcccgcctcctcctgccaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368507 - DNA, 1208 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcaccggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368508 - DNA, 1246 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggagacccttcagccacgttcttcagtggagaccaagatagcagagcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368509 - DNA, 1449 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagcccctgtccatccaccagctcgcagcacagggggagctggaccagctgaaggagcatttgcggaaaggtgcgtgtccacacacatgtgctggcatgtctgcacctggctggtgtgtgcatatgggtgtccatacccactcatgacgtgacctgtgagtgtccacgtgtatgattgtatctaactgtgtgtgtgaccgtgttcatgtatgtccatcaacatacgctccccctcattcccctgtctaaccccagccccccacctcgtccccatttggcagcactggggatagggggcaggggtgcagcctggtggtattgcccgcctcctcctgccaggtgacaacctcgtcaacaagccagacgagcgcggcttcacccccctcatctgggcctccgcctttggagagattgagaccgttcgcttcctgctggagtgggtgcgtcccagcccagctggcagcgtggggggttcccgggggccttagggtgggctggggttttggctgtgtctgctggcgccttgtctttgagatgcggctgctggctgggtgcagtggctcatgcctgtaatcccagcactttgggaggccgaggcgggtggatcacttgaggtcaggagttcaagaccagcccggccaacatgggtgaaaccctgtctctactaaaaaaatacaaaaattagccaggcgtcgtggtgggtg

SEQ ID NO: 368510 - DNA, 1404 bp, Homo sapiens
gcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368511 - DNA, 776 bp, Homo sapiens
gcagccccggcgactggagaagccaccctgaaactggatctgcagctgggagacacggatgagctggggaaactccagcgtcacccactgggagggccctggaagcagacagggaaactgaggcgcaagctcactgcaggcacagagccctgctatgcctgtctcattcacatagttcttggaatggaggggaagaaggaaattcggcacatgttcctttcctggtcgaaaagatgtttttttccaaactgccgagtgttgcgattcagcactgaactcaccctggaggcaccaggatcaaggcgaagagaggggctgagaccagctctcagctccgcggagggcctgacccccagatctgtccactgagggctcgaccccaggcttagggcctcgccactgcctgtccccacagactcttacctgctcactgtctctggacaaaccaaagagtgggtcatgtcggttccacaagacctcgcagggcttaggattgggcacagccttggttcgaatcccggcgcctcctcaagctacagggcggcgcgatcttggctacgccttggcctgaacgtcctcacctgtaacttgggacgagaaccgccactccctcgcccaccccagtcctaaatgtcgcctcgatcaatcccctgccggaaaatttgggagagaggatcagggaaaccgccaatgcccggaggccaggcctttcacaggaaacagatttcccgcgggtttcgggggcggtggctttttgtgcgaggctgtttctctgc

SEQ ID NO: 368512 - DNA, 1535 bp, Homo sapiens
gcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaaggtacgctgcccctttaagttccagacgccccgcgtacttcccctacttcttcttcttgagatagccccgcccatctacccgaagccggagccaattggctccctctggaaaaatctgtgggcagggtaaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368513 - DNA, 1202 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368514 - DNA, 1053 bp, Homo sapiens
acctcaaacagaccgtttccccgcgcacacacacgtctctcgtcgcaacctttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368515 - DNA, 1408 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagcccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368516 - DNA, 1617 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagcccctgtccatccaccagctcgcagcacagggggagctggaccagctgaaggagcatttgcggaaaggtgcgtgtccacacacatgtgctggcatgtctgcacctggctggtgtgtgcatatgggtgtccatacccactcatgacgtgacctgtgagtgtccacgtgtatgattgtatctaactgtgtgtgtgaccgtgttcatgtatgtccatcaacatacgctccccctcattcccctgtctaaccccagccccccacctcgtccccatttggcagcactggggatagggggcaggggtgcagcctggtggtattgcccgcctcctcctgccaggtgacaacctcgtcaacaagccagacgagcgcggcttcaccggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 368517 - DNA, 1040 bp, Homo sapiens
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtgggtgcgtcccagcccagctggcagcgtggggggttcccgggggccttagggtgggctggggttttggctgtgtctgctggcgccttgtctttgagatgcggctgctggctgggtgcagtggctcatgcctgtaatcccagcactttgggaggccgaggcgggtggatcacttgaggtcaggagttcaagaccagcccggccaacatgggtgaaaccctgtctctactaaaaaaatacaaaaattagccaggcgtcgtggtgggtg

SEQ ID NO: 368518 - DNA, 1124 bp, Homo sapiens
  misc_feature (902)..(902): n is a, c, g, or t
gaaggccaggcgcaactgccctcccaggacccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggatggaggggacgcactgctgtacgctgtgcgcggaaccacgtgaatgggtgggctggtggccgagngctgactcacacgagcgatctggtaaccgatgactgccggcccggatacgaaggaccggatcagacacatccagtctcaagactggcgtgactggagagccgcggaccacaccgcaagtccaggaccaaggtcaggtggggggggggcccagaaactggaaaaaccgtctgggagggagagcttccctcagacggcgtacaacaaaacaaagagaggaccac

SEQ ID NO: 368519 - DNA, 564 bp, Homo sapiens
aaaaaaactaaaaaactcttaaaaaacctgaggactcctggatgaatactgttatgtgcctgtttctcaattacccctggcctgagtgaggaacttttggaactctttggctcccagactgtggtgggcactaccggtcagctgcccagcagccagccctagtcccacttctgcctcatttgttacaggttggaagtgccaggttcagggatgggcctgtgacccaagttttagctgaaaggaaacctactagggacttctaggagagattttcttgcttgtaaagggaaggctacacaaggagaaaagccctttctaaccacatccccttatttcatgcttgggatgctgaccatgtgaagacttggttgttggagctgtggtggcctccctgccatgatgaggggagaaggcactgccacactgagcgtggcagtgggtacaggaagagtccagtctccgggatgccttggttaattgacaggacaaaccctggaactgccaacttccatcttgttctgtaataataaatctctaatatttgtaccactttcagtcgagtat

SEQ ID NO: 368520 - DNA, 802 bp, Homo sapiens
tatgtatgagtgcgtgactgggatttcaatatcagtcgagaggcgggcgtctgtatcatgacctggaaggccgcggctgatagaatggatggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgttataacacccatggtgtcagcggacatccctaagatcctgggacccgtgct

SEQ ID NO: 368521 - DNA, 700 bp, Homo sapiens
  misc_feature (467)..(467): n is a, c, g, or t
ggaggtggacctcgggacatggcctcttctgctcccgggagcccccctcaggagcaggagggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctctagcagcagcgaaaaaaaaaaaaaaaaaaaaaaanaaaaaaaaaaaaaaagaaaaaagaaaacaaaaaaaaaaaaaaaaaaaaaaaaaaaaaagtactgatggtggtgaataaagaccaaagggtcctctctacctttgaaaactctcctggggtggaggagaccagggcaggatagacagacctctgcagtaagagagtggttgggaaacccagggtgttcccttggatctcagatctgagccatcgagggaagagtgggctgctaa

SEQ ID NO: 368522 - DNA, 519 bp, Homo sapiens
  misc_feature (21)..(21): n is a, c, g, or t
ttgagggtggaaatccccccncaattccggggacatggaattaggggcagaagagtttcctgacttaagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368523 - DNA, 3297 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368524 - DNA, 3409 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368525 - DNA, 3222 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcactggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368526 - DNA, 3361 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagggccactgtctctgtctccctgcccagattctggcacacagcctggtggtgttccgagtgctcccactggccccctgggaccccctggtcatggccaaaccctgggggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcactggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368527 - DNA, 3235 bp, Homo sapiens
  misc_feature (3210)..(3210): n is a, c, g, or t
  misc_feature (3214)..(3214): n is a, c, g, or t
  misc_feature (3217)..(3217): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctctaaaaaaaaacaacaagacacacaaanacancancacaacacacaaaagggg

SEQ ID NO: 368528 - DNA, 3451 bp, Homo sapiens
  misc_feature (3218)..(3218): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctctagcagcagcgaaaaaaaaaaaaaaaaaaaaaaanaaaaaaaaaaaaaaagaaaaaagaaaacaaaaaaaaaaaaaaaaaaaaaaaaaaaaaagtactgatggtggtgaataaagaccaaagggtcctctctacctttgaaaactctcctggggtggaggagaccagggcaggatagacagacctctgcagtaagagagtggttgggaaacccagggtgttcccttggatctcagatctgagccatcgagggaagagtgggctgctaa

SEQ ID NO: 368529 - DNA, 3242 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctctaaacaaaaacccacaaccccccccccacacaacaccgactgccacgcccgcacaccccaaccaacaaacacgcgcgcccgcgccccccgacacaacacaccccccccgcaggaccaccccaagctcgcacaccccacactcgacccgccacaccgaagcgccccccccaccggcccccccccccacgcacccgccgcgccgaccc

SEQ ID NO: 368530 - DNA, 3088 bp, Homo sapiens
  misc_feature (3063)..(3063): n is a, c, g, or t
  misc_feature (3067)..(3067): n is a, c, g, or t
  misc_feature (3070)..(3070): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctctaaaaaaaaacaacaagacacacaaanacancancacaacacacaaaagggg

SEQ ID NO: 368531 - DNA, 3167 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcaggccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368532 - DNA, 2914 bp, Homo sapiens
  misc_feature (2843)..(2843): n is a, c, g, or t
  misc_feature (2858)..(2858): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctncatcctgttcatccngggagcccccttaaggagcaggaggtggacctcgggacatggcctcttctgctgtt

SEQ ID NO: 368533 - DNA, 3041 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368534 - DNA, 2127 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368535 - DNA, 2809 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368536 - DNA, 2589 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgatgtctcaatggcttctgaatgactgttctaataaatgatcttaaaacagt

SEQ ID NO: 368537 - DNA, 2033 bp, Homo sapiens
  misc_feature (1800)..(1800): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctgcagcagcgaaaaaaaaaaaaaaaaaaaaaaanaaaaaaaaaaaaaaagaaaaaagaaaacaaaaaaaaaaaaaaaaaaaaaaaaaaaaaagtactgatggtggtgaataaagaccaaagggtcctctctacctttgaaaactctcctggggtggaggagaccagggcaggatagacagacctctgcagtaagagagtggttgggaaacccagggtgttcccttggatctcagatctgagccatcgagggaagagtgggctgctaa

SEQ ID NO: 368538 - DNA, 1813 bp, Homo sapiens
  misc_feature (1580)..(1580): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctgcagcagcgaaaaaaaaaaaaaaaaaaaaaaanaaaaaaaaaaaaaaagaaaaaagaaaacaaaaaaaaaaaaaaaaaaaaaaaaaaaaaagtactgatggtggtgaataaagaccaaagggtcctctctacctttgaaaactctcctggggtggaggagaccagggcaggatagacagacctctgcagtaagagagtggttgggaaacccagggtgttcccttggatctcagatctgagccatcgagggaagagtgggctgctaa

SEQ ID NO: 368539 - DNA, 2937 bp, Homo sapiens
  misc_feature (2749)..(2749): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagttttgtgagtaacccttctctattcctttcctctcctgggtctggtcaaggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgaggctgggggtcaacctgcttctgtccccaagntgaagactcgggggggaaccccgggggacgggcgcccatatgcggcgagcgctggggatgggagcaatgcgtagaccgaaccactctcgcgggggtggtgcccccccagagagaggcgaggcgagggcgacacaaagcgacctgcgagaggtccttcaccccggagcagtcgaacgctctcatggacc

SEQ ID NO: 368540 - DNA, 149 bp, Homo sapiens
ggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcag

SEQ ID NO: 368541 - DNA, 655 bp, Homo sapiens
cagacagtgacgacggcgtactcggttttgtattgcacttgatgggccatgcgcttacattgatatcattagctggcagtcggctgacaatttcacagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggtgagtggctggcttgccattc

SEQ ID NO: 368542 - DNA, 852 bp, Homo sapiens
ccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368543 - DNA, 3185 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368544 - DNA, 3077 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368545 - DNA, 3436 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagggccactgtctctgtctccctgcccagattctggcacacagcctggtggtgttccgagtgctcccactggccccctgggaccccctggtcatggccaaaccctgggggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368546 - DNA, 3038 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368547 - DNA, 3458 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagtgtgcttggggggggaaatgttagcttctgagggatggccttgtgtgcttgctgggatcatagggacttggccagcgtttctccaacctgcttactttttctctttagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368548 - DNA, 3304 bp, Homo sapiens
  misc_feature (3071)..(3071): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctctagcagcagcgaaaaaaaaaaaaaaaaaaaaaaanaaaaaaaaaaaaaaagaaaaaagaaaacaaaaaaaaaaaaaaaaaaaaaaaaaaaaaagtactgatggtggtgaataaagaccaaagggtcctctctacctttgaaaactctcctggggtggaggagaccagggcaggatagacagacctctgcagtaagagagtggttgggaaacccagggtgttcccttggatctcagatctgagccatcgagggaagagtgggctgctaa

SEQ ID NO: 368549 - DNA, 3392 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagttttgtgagtaacccttctctattcctttcctctcctgggtctggtcaaggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368550 - DNA, 3116 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368551 - DNA, 2894 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368552 - DNA, 2786 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368553 - DNA, 1921 bp, Homo sapiens
  misc_feature (1688)..(1688): n is a, c, g, or t
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctgcagcagcgaaaaaaaaaaaaaaaaaaaaaaanaaaaaaaaaaaaaaagaaaaaagaaaacaaaaaaaaaaaaaaaaaaaaaaaaaaaaaagtactgatggtggtgaataaagaccaaagggtcctctctacctttgaaaactctcctggggtggaggagaccagggcaggatagacagacctctgcagtaagagagtggttgggaaacccagggtgttcccttggatctcagatctgagccatcgagggaagagtgggctgctaa

SEQ ID NO: 368554 - DNA, 2528 bp, Homo sapiens
acaagagcctcccggaccttcaaaggagggtgcagggcccccggagagtaagcagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctcagcacagggcacgctgataaactgggtacccagcccgagggcacaccccaccagcgggacgcccccatgtaggactctcacaagacgcacgacagccaaggcacgcccagaatgcacccgggcaagcagaacaccccgccatcgcagagccaacacaacaccagcacacgcaagccaccgccgacagcgccaccaccaacaaactacatacaaaccgaaagaacaagagacgcctcctcaacctcacgacacagcgcaaccccaggccgacagcggaacaggcagtctacataaaccgccacgtgacgcgcggcacgactgctgcggacgccggggacacgagcacgacgagccagctaccagcgatgcggtgagcagtacacatagaccgaggggaaagcgccagcaacgtcgtcctggccagccacgagacgcacctgacgaccgagccccgcagcgcaagccgtccggaccactcgcgcgcgggccaggcgcagctgggaggcgcacccgaacgcacggccgggcgacatagcaaacgaccgacagagttagccagacagcgtgagaagctacaaacgacgacgacagcacaccgacagttcgaggccactggcagcacaaagcacccctccgtagcacacagccgcgccgaggcgccaaccacacccgaagacagaacgcagacaacaagagagcacccacgcgaatccaagagaacagagacgaatataccaatcagcgagacgaacacgacaaccagcccgacatcgcgcgccgtacgaagaacatccaagcagatcacctataggagcaagcgccacacgcagtcgtacagctagacgtgcacccaaaacaactagttaatatag

SEQ ID NO: 368555 - DNA, 930 bp, Homo sapiens
gctggcccggttgtctggtccaggttgtgctctcctggagatggacaggtcttggtgaggaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgcttctctcta

SEQ ID NO: 368556 - DNA, 2499 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgcgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatttttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcttctcatttcattatcttttttttttttttttaaagacagattctcactcagttgcccaggctggattgcgggggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatctactttttggtgtacagttctgagttttggcaaatgcagtcaagtcactaccaccaccacaattaacagctatatcaccctccagtaaattccctgtggtcagctccttccccaccttttaccgtggcaaccgtcaagctattctctgtccctataccaggtgtcatcaaatttttttctggaaaggcccatgcagtaaatagttcaagctttgtgggcttttatagtctctgttgctgctgctgaactcagctgttgtagcacgaaagcagccaggtaattactagatgaaggaatgcaggtggctgtgtttcaatagagctttatttctgcaaactgaaacttgagttttgtgtaattttcatgtgtcatgaaatactgttttctccaaccatttaataatgtaaatacttgctagcttatgtgccattaaaaaatgacttgatttggcttacaaa

SEQ ID NO: 368557 - DNA, 380 bp, Homo sapiens
agagagagagagagagagagagagagacatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatct

SEQ ID NO: 368558 - DNA, 2042 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgcgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatttttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcttctcatttcattatcttttttttttttttttaaagacagattctcactcagttgcccaggctggattgcgggggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatct

SEQ ID NO: 368559 - DNA, 2042 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgcgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatttttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcttctcatttcattatcttttttttttttttttaaagacagattctcactcagttgcccaggctggattgcgggggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctccaccacaccccccaccccatggtgggtgagggtatcccctgtgtgtcccaggccaataaaatctacctgccactgaaaa

SEQ ID NO: 368560 - DNA, 1949 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgcgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatttttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcttctcatttcattatcttttttttttttttttaaagacagattctcactcagttgcccaggctggattgcgggggcgctgtctcagctcactgcaacctccgcctcccaggagaatcgcttgaactggggaggaggctgaggcaggagaatcgcttgaactgggaaggaggctgaggcaggagaatggggaggcataggtcgcagtaagcgtgagatcatgccactcgtgcactccagccggggtgacagagtgagactgcgtctcaaaaaaaaaaaaaaaaattgggggctccaggcggggcgcaggttgtccagtgcctggtaatccccagtaccttggggaggctgaggggggaggatcattggaccccgggagttttaaagaccagtcggggcaaagttggtgaaccctcatttttcctaaaattgcaaaatttacctggggcgtggtgtggccaggccgtgtattccca

SEQ ID NO: 368561 - DNA, 761 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaaaa

SEQ ID NO: 368562 - DNA, 347 bp, Homo sapiens
gagacaccatggtttgtactcattggactggaaagaggcctatagcgttcgttaggagacaatgctagtttctttgatattttacccagaaatgcagcctgaatttcatcttgttttggaacctcttatagaggtcaaagcaggaactagtacattttgaaatgtgcattgctgtgttcatagtctaccataaccaattgctgatgtacgctttatgtttttaagatatattaccaaagaagattttagctagtaaatacctgaaaatgcttaaagaggaaaagagggaagaagatgaggagaatgacaatgataatgaaagtgaccatgatgaagctgactcctaa

SEQ ID NO: 368563 - DNA, 814 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaggaggtaagcgagaaaaaatggaaaggggagccggaaatggaggagagaggacaagcaaagagacagaaatgaagacttgaggaaaagctgggggaagcaggagaggaagggacgggatgtaggacggggaagaaaaaatcggagatgagaccaaaagaaatgtgtgggagacggtagagaacgaaatggcaggggtggtttggttttctcaagactgtgaaattgagcccatggctttgaagagagaggagggccggtcctgggt

SEQ ID NO: 368564 - DNA, 2372 bp, Homo sapiens
agatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacgatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgcgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatttttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcttctcatttcattatcttttttttttttttttaaagacagattctcactcagttgcccaggctggattgcgggggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatctactttttggtgtacagttctgagttttggcaaatgcagtcaagtcactaccaccaccacaattaacagctatatcaccctccagtaaattccctgtggtcagctccttccccaccttttaccgtggcaaccgtcaagctattctctgtccctataccaggtgtcatcaaatttttttctggaaaggcccatgcagtaaatagttcaagctttgtgggcttttatagtctctgttgctgctgctgaactcagctgttgtagcacgaaagcagccaggtaattactagatgaaggaatgcaggtggctgtgtttcaatagagctttatttctgcaaactgaaacttgagttttgtgtaattttcatgtgtcatgaaatactgttttctccaaccatttaataatgtaaatacttgctagcttatgtgccattaaaaaatgacttgatttggcttacaaa

SEQ ID NO: 368565 - DNA, 1828 bp, Homo sapiens
  misc_feature (18)..(18): n is a, c, g, or t
acaaggctggtacgcccnggatgttatggagggccgctcccggcctcgcggcctcgcctccccacactacaactcccacggggcagcgggcgcggctccccgtacccaccagctggccgggcagggcaacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatttttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcttctcatttcattatcttttttttttttttttaaagacagattctcactcagttgcccaggctggattgcgggggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatctactttttggtgtacagttctgagttttggcaaatgcagtcaagtcactaccaccaccacaattaacagctatatcaccctccagtaaattccctgtggtcagctccttccccaccttttaccgtggcaaccgtcaagctattctctgtccctataccaggtgtcatcaaatttttttctggaaaggcccatgcagtaaatagttcaagctttgtgggcttttatagtctctgttgctgctgctgaactcagctgttgtagcacgaaagcagccaggtaattactagatgaaggaatgcaggtggctgtgtttcaatagagctttatttctgcaaactgaaacttgagttttgtgtaattttcatgtgtcatgaaatactgttttctccaaccatttaataatgtaaatacttgctagcttatgtgccattaaaaaatgacttgatttggcttacaaa

SEQ ID NO: 368566 - DNA, 817 bp, Homo sapiens
ggtgggggaggatgtggccaccaggctctgacagcaggcacagagcagcagcacggggggggtggagcgggagcagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcgaaaaaaaaaaaaaaaaaaaaaaaaaaaaaaaaaaagagagaaaaaaaaaaagaaaaaaaaagggggggggggggtaaaagagattttctcccatgaggggggcgcccaaggtttgagggcgcgcagccacaggtttttggtgcgagaacagaaggggggcccacaaagaggagaggggctgttttataagacgggaggagcgtgcgcccagcgggattaaaaaagaggcgggagcgcgcgggagaacacacgagggcggccggggggagccctttcgggccaggagcaacccctcccaccggggcggggcggggcacaacaggggaacagacatcccgaaagagaggtctttgaggaccacaccgaggggggcaccacaaaacacgcgcaaaacagggcgaacaaaaggggccgcaccacacaaacacggggcgaaaacaacaacagggagcaggaacaaggtggagcacacacggagcaaacgacaacgcgagacaccaattaccaccccg

SEQ ID NO: 368567 - DNA, 5733 bp, Homo sapiens
ggcggccgccccggccgacagcgcccgggaacacggctcgcaggccgggggcaaggggcggccgggcgcggccggtgagcggggccagggccagcgggccgctgggcggggggcgccggaccagggcgggcgggttcgggactccgcggggatcgccgccttccctccgcgtcgggcccggttgtatctcgctggggccttcaccgggtcgcccccgcgctgaaggtcaccttcacagtcgcccccggctgcggcccgggtttcgcacgtgcggtcccgtggagggcagcctcggctggcaccctcggcgggcacacgcgcgcctcatcgcggggacacgtgcgcgcacacgcggtttcggggtgcgccgccgccgcagaccgaaagaatcggcggccccaccccctctgcgcccgagcatgggagctctctgagctggggtcgctccgacgtttgcgggacagcccccttcggcacctgctccgcggcggcctcccaggcattccctgtgcgcagggctgcagccctgggagtgaagctccgctcgaggcttcccaggcttggtttgtgggaagagcacgagagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368568 - DNA, 4933 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368569 - DNA, 3079 bp, Homo sapiens
tcccacatggttagagggggcctgtaccaccaccgggctcttggttcttggcctgcgctcctgccagaggctgggcacattctgacatcctgactgggagctggagccttcggggtccttctccagggcctcccaggatagctgtgctcccccagaaggactcagttgggtggaggcagaggagctgggtgggggcctgagctgctgcagcccgcaggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368570 - DNA, 5173 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368571 - DNA, 5354 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcgaaaaaaaaaaaaagggggcggcaaaaatccccagagggccaagtaacgcgaacccggttttggacaaaggcccaagagacggataaaagaagaaggcgccatttaaaccgtgcgggaatgtctggactgg

SEQ ID NO: 368572 - DNA, 4257 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtg

SEQ ID NO: 368573 - DNA, 2654 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368574 - DNA, 2759 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacaggagtcgagctctccgggctctcagccgcatcagcattctgaaatggttcctgggtcctaccaaaccgtggccaacggcgcgaagagtgtctcaagagcggataggggggaaacggccggggtgggataaaagctggtgttgacccaggttggaacttgggggcagatattggtcctgtggc

SEQ ID NO: 368575 - DNA, 429 bp, Homo sapiens
cgcaagaacctgcctgagcggctgctccgagaaagggccatattcaaggtgcctgcagcctctgctgaccggcagtctgaggcccgctgtccacctgctgacgggttttctcatggagaggaggaaagcaagggaggcaggggcagccctaaccctgtcaggttccccgaaggccagtcagcgtctcccgcagggtctgctagccttccgcctcccagcagaccatcccagtacctttctctggcctctctgaggctttgagtccctggaaggagcgggccctacttcccatagggactgagtgtccagggccgtgcagcttcccgccctctgtgactgctgcggggcttttgcctgggcgagcactggccggccatggcccttctagggcgggtgctcatttgcataacacttttagtttgctggggt

SEQ ID NO: 368576 - DNA, 5224 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368577 - DNA, 4579 bp, Homo sapiens
gctcttctgcctttgacgccagggagcggccatcttgtgttcccttgcagccccaacaccgtgactggatatgcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368578 - DNA, 3204 bp, Homo sapiens
ctctcctccggcggggtcgaagaaggtggtgttgaggttgcggtctgttagtagtatagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368579 - DNA, 5014 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagtcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 368580 - DNA, 3240 bp, Homo sapiens
ggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgtacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcgagaggtgggaccacgggaacaagatctcctttctggttatatcttccttggggcagagggagtttcagacaagacttctggcaagactgggacccaccttatctggcttcactcaggagcctggctcaatggaccaaggactgccctcccggaggaagctactagggtcatcagagtgttggatgatgtcaggctatagcccacacatgctgagcagcagcatcatctgtgcgggatcctctagaca

SEQ ID NO: 368581 - DNA, 1117 bp, Homo sapiens
ggctgacttcgctgcccgtcacgggaatgcgggagagggcggcgccggggcgctcgcgtctgcgtggagaccggctggccgcgcgcgggaagccgcggaactgcgccggaaagtcccccggctctggggccccggtgacccagagtaagcctccaagaaggaggaggaggagagaaaggcggctcttcccgtgcccctaccagaggcttcggtgggcccaccttgtgacctccgcggccggcccctcagtggaactgcgtcccacgcggggggcgtcccgaccgtgggggccgcggcccgcgctgaccctggacgtcgccgcgcagcccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctt

SEQ ID NO: 368582 - DNA, 1564 bp, Homo sapiens
ggctgacttcgctgcccgtcacgggaatgcgggagagggcggcgccggggcgctcgcgtctgcgtggagaccggctggccgcgcgcgggaagccgcggaactgcgccggaaagtcccccggctctggggccccggtgacccagagtaagcctccaagaaggaggaggaggagagaaaggcggctcttcccgtgcccctaccagaggcttcggtgggcccaccttgtgacctccgcggccggcccctcagtggaactgcgtcccacgcggggggcgtcccgaccgtgggggccgcggcccgcgctgaccctggacgtcgccgcgcaggtacgttgccgtcccccggcggtctgacccccgagacagcccctagtgcataccccacgccctcctccattgtcgagaatgagacacggctgtgcctttgtccacgtggtagagttgccgccgcggtgaggctctcgcctgtgcaaaaagcgtggcagcgaattctcatcaacgaggggaggcgcgtcccctcacagcgcagctctcgggtctgaggagggccgggcagggcgtgcgtctgtctaggtttgaattaaaggcgactcacaggaaataaggccatgccactgtggtagcttttcccgtccatctccggacactcgacggtgtgggtcgtgcgaggaggcggcagtcttcacagcctcttactctagtcctcacggtcaggttctttttctgatttgacacagacagcgggactgacgacctcataggtagctgaaaacccccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctt

SEQ ID NO: 368583 - DNA, 681 bp, Homo sapiens
  misc_feature (41)..(41): n is a, c, g, or t
  misc_feature (43)..(43): n is a, c, g, or t
gggcggtcaggatgaagttctggttgaagtcccgttgtttntncccctcaaactgcactgatccacagatgacaacaaggaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctt

SEQ ID NO: 368584 - DNA, 549 bp, Homo sapiens
  misc_feature (24)..(24): n is a, c, g, or t
gcccaaagaaattcggccacgagnagcgagtccccaattcaggctgccagtctaccacgctgatttggaactcgctggaaggcaacattccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgccc

SEQ ID NO: 368585 - DNA, 1056 bp, Homo sapiens
ggctgacttcgctgcccgtcacgggaatgcgggagagggcggcgccggggcgctcgcgtctgcgtggagaccggctggccgcgcgcgggaagccgcggaactgcgccggaaagtcccccggctctggggccccggtgacccagagtaagcctccaagaaggaggaggaggagagaaaggcggctcttcccgtgcccctaccagaggcttcggtgggcccaccttgtgacctccgcggccggcccctcagtggaactgcgtcccacgcggggggcgtcccgaccgtgggggccgcggcccgcgctgaccctggacgtcgccgcgcagcccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgccc

SEQ ID NO: 368586 - DNA, 610 bp, Homo sapiens
  misc_feature (24)..(24): n is a, c, g, or t
gcccaaagaaattcggccacgagnagcgagtccccaattcaggctgccagtctaccacgctgatttggaactcgctggaaggcaacattccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctt

SEQ ID NO: 368587 - DNA, 516 bp, Homo sapiens
  misc_feature (24)..(24): n is a, c, g, or t
aggatccccggttcactttctacncgcgaccaagcagttggggaaagtaattttgtttgccgaagtgacccccacaacgatgcgtctcctggatgggtaaggtgtgagcaggtctgcatctgctcagaggagtcctgttccattgatcatcctctcttaccaatagacggggaggggatagagttgtagaggaatacgtttgaccagacctattagcaaggtggaagtactcttgtcctagaagagttaaatcgtgggaaaggaaattgaagttctttgatcacaggtttgttttttatgggaatggaaggtggttgtgctttgtgtcttgcttctttgaatcaggccctcagaatgttctttgataaacgaatattatgaaaaaagatgtttaaccggtggcattattgctcaggttatcattcttcttttgtgcagttacaatcagtgttagacatttaatacaggatgtttttcaggggcatttgaataggaagtttgaatgacacctaagct

SEQ ID NO: 368588 - DNA, 7831 bp, Homo sapiens
  misc_feature (20)..(20): n is a, c, g, or t
aattcggcacgaggatgatntggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcaaagcgggctcgccctgccggcggcgcggccatgctcatcacgctgtgctacctgtacctgtgggcgcgctggggtcgccggccggctgagctcgtgcgcgccacggtgcggcggctgcgtgcctcgcgctgttccttcaccttctgcggcgcggccgcggagcccccgggcgcccgcgtgtgcctgagccgtggcggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacaggtgcacgctaccatgcccggctaatttttgtatttttagtagaggcgggggtttcaccatgccatccaggctggtttcgaactcctgacctcgtgatccacctgtctcggcctcccaaagtgctgggattacaggtgtgagccaccgcgcctggccctgtattttcaaattctttacctctgcgtttccagccttgctccatccaatttgttactagagctttttaacaatttcacgttgaattaagatgatttggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcagagaagatatgccttgcctgctgccatacattgtaacatcaagtcaagagctttagttacttaacagatttctgctggctgctattataggaggaaactcctttgtttagggacagccagggcttccttagctttgatctttgggagtgagccttttgcttgacttcccttctcttttccatgcctttgtttccatctcgaagtgcaaatttaaagtgtcctgtttgcctttatccactggaaggcaaacaccctggacgacgtatcagtgacagcgcggttctgctttgatcggagcacccagcgctgcttgaaggcgtttgcatggtccatggctcatggaccacgctcctagaaaacggaaatgcacttagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaacagctagatggtttttaggatttttcttttcttttgtggaaacttcttgacttgacttttcatctgaacagtttttccccccaagattttaatcttatatgtcatacttaagtttaggaacagcttgaataattagcattctagataacacaagggccatgattcactaaaattccaagctactgtaattttatggcatttatttgcaaatgttctttgtatctcattttatctgtagcagtccccactagtctaccttaaccatcttatagctctggtaaattaaaacttacgtagactttatacaagatccattggccgtattaaacctcccccactcttagggcttagggcggaagggacgaaggcagggctgataggacttttaaaaggataaaaggagtgggggcaagggaggcggaaaatacaggctcttgcagataccctccgcgctgccctccacacccagcccactgctctacaaaggtatgaatggaatggcttttctagaaaagggcttccaagaacataaaggaattcctttccctgggaggccccgtggagggctgagccagccttgaattgggcttatttctcaaatccatttgatctggcatttttgtcaacatggtacatgttagg

SEQ ID NO: 368589 - DNA, 6876 bp, Homo sapiens
  misc_feature (20)..(20): n is a, c, g, or t
aattcggcacgaggatgatntggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcaaagcgggctcgccctgccggcggcgcggccatgctcatcacgctgtgctacctgtacctgtgggcgcgctggggtcgccggccggctgagctcgtgcgcgccacggtgcggcggctgcgtgcctcgcgctgttccttcaccttctgcggcgcggccgcggagcccccgggcgcccgcgtgtgcctgagccgtggcggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaacagctagatggtttttaggatttttcttttcttttgtggaaacttcttgacttgacttttcatctgaacagtttttccccccaagattttaatcttatatgtcatacttaagtttaggaacagcttgaataattagcattctagataacacaagggccatgattcactaaaattccaagctactgtaattttatggcatttatttgcaaatgttctttgtatctcattttatctgtagcagtccccactagtctaccttaaccatcttatagctctggtaaattaaaacttacgtagactttatacaagatccattggccgtattaaacctcccccactcttagggcttagggcggaagggacgaaggcagggctgataggacttttaaaaggataaaaggagtgggggcaagggaggcggaaaatacaggctcttgcagataccctccgcgctgccctccacacccagcccactgctctacaaaggtatgaatggaatggcttttctagaaaagggcttccaagaacataaaggaattcctttccctgggaggccccgtggagggctgagccagccttgaattgggcttatttctcaaatccatttgatctggcatttttgtcaacatggtacatgttagg

SEQ ID NO: 368590 - DNA, 4370 bp, Homo sapiens
tgcagatggtacgggttactgttagtcacattaaatccacagccaataagtaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaacagctagatggtttttaggatttttcttttcttttgtggaaacttcttgacttgacttttcatctgaacagtttttccccccaagattttaatcttatatgtcatacttaagtttaggaacagcttgaataattagcattctagataacacaagggccatgattcactaaaattccaagctactgtaattttatggcatttatttgcaaatgttctttgtatctcattttatctgtagcagtccccactagtctaccttaaccatcttatagctctggtaaattaaaacttacgtagactttatacaagatccattggccgtattaaacctcccccactcttagggcttagggcggaagggacgaaggcagggctgataggacttttaaaaggataaaaggagtgggggcaagggaggcggaaaatacaggctcttgcagataccctccgcgctgccctccacacccagcccactgctctacaaaggtatgaatggaatggcttttctagaaaagggcttccaagaacataaaggaattcctttccctgggaggccccgtggagggctgagccagccttgaattgggcttatttctcaaatccatttgatctggcatttttgtcaacatggtacatgttagg

SEQ ID NO: 368591 - DNA, 230 bp, Homo sapiens
gcttttacctcctggccccaagaggcacttcaatatcggattgtcccaaagaagtgattagctgcctgaaaaagaggagaggacgaggcccatgttaccttggtttctgcttatcttcccttagctcagtgacttgcctgggccccttgtgtcctgtgacggcttaattaatgtgcagatttccctttaggatatcaacttacgagtgaagtggcccaacgatatttatt

SEQ ID NO: 368592 - DNA, 6650 bp, Homo sapiens
acgagagggcgcagcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacagttcggtttttgcccactagggatgatgtggtttctcatgaggttacttgctctaaaggactttatattttggaaccataagagcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaacagctagatggtttttaggatttttcttttcttttgtggaaacttcttgacttgacttttcatctgaacagtttttccccccaagattttaatcttatatgtcatacttaagtttaggaacagcttgaataattagcattctagataacacaagggccatgattcactaaaattccaagctactgtaattttatggcatttatttgcaaatgttctttgtatctcattttatctgtagcagtccccactagtctaccttaaccatcttatagctctggtaaattaaaacttacgtagactttatacaagatccattggccgtattaaacctcccccactcttagggcttagggcggaagggacgaaggcagggctgataggacttttaaaaggataaaaggagtgggggcaagggaggcggaaaatacaggctcttgcagataccctccgcgctgccctccacacccagcccactgctctacaaaggtatgaatggaatggcttttctagaaaagggcttccaagaacataaaggaattcctttccctgggaggccccgtggagggctgagccagccttgaattgggcttatttctcaaatccatttgatctggcatttttgtcaacatggtacatgttagg

SEQ ID NO: 368593 - DNA, 6681 bp, Homo sapiens
  misc_feature (16)..(16): n is a, c, g, or t
  misc_feature (185)..(185): n is a, c, g, or t
ggccgcccggggctcnggggactcgggtgtccaggtgccgaagtcgccgcttcacgggggactcaggcccgtgagtgggtttcctaagaacttaccagattccacggctcgggtttcctgccttggatcctgctttttattccccagggggagttatttatagacaggaatcgtgtgttcaaggnctggctcttcggactcggcgtttttcttgttcgaggtgcttcaatgggggctggatgccatcatcttccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaacagctagatggtttttaggatttttcttttcttttgtggaaacttcttgacttgacttttcatctgaacagtttttccccccaagattttaatcttatatgtcatacttaagtttaggaacagcttgaataattagcattctagataacacaagggccatgattcactaaaattccaagctactgtaattttatggcatttatttgcaaatgttctttgtatctcattttatctgtagcagtccccactagtctaccttaaccatcttatagctctggtaaattaaaacttacgtagactttatacaagatccattggccgtattaaacctcccccactcttagggcttagggcggaagggacgaaggcagggctgataggacttttaaaaggataaaaggagtgggggcaagggaggcggaaaatacaggctcttgcagataccctccgcgctgccctccacacccagcccactgctctacaaaggtatgaatggaatggcttttctagaaaagggcttccaagaacataaaggaattcctttccctgggaggccccgtggagggctgagccagccttgaattgggcttatttctcaaatccatttgatctggcatttttgtcaacatggtacatgttagg
